US010124061B2

(12) United States Patent
White et al.

(10) Patent No.: US 10,124,061 B2
(45) Date of Patent: *Nov. 13, 2018

(54) ANTI-TIGIT ANTIBODIES, ANTI-PVRIG ANTIBODIES AND COMBINATIONS THEREOF

(71) Applicant: Compugen Ltd., Holon OT (IL)

(72) Inventors: Mark White, Antioch, CA (US); Sandeep Kumar, San Bruno, CA (US); Christopher Chan, South San Francisco, CA (US); Spencer Liang, San Mateo, CA (US); Lance Stapleton, Oakland, CA (US); Andrew W. Drake, Mountain View, CA (US); Yosi Gozlan, Tel Aviv (IL); Ilan Vaknin, Tel Aviv (IL); Shirley Sameah-Greenwald, Kfar Saba (IL); Liat Dassa, Tel Aviv (IL); Zohar Tiran, Oranit (IL); Gad S. Cojocaru, Tel Aviv (IL); Maya Kotturi, Belmont, CA (US); Hsin-Yuan Cheng, San Mateo, CA (US); Kyle Hansen, San Francisco, CA (US); David Nisim Giladi, Netaniya (IL); Einav Safyon, Raanana (IL); Eran Ophir, Even Yehuda (IL); Leonard Presta, San Francisco, CA (US); Richard Theolis, Santa Cruz, CA (US); Radhika Desai, Brisbane, CA (US); Patrick Wall, Mill Valley, CA (US)

(73) Assignee: Compugen Ltd., Holon (IL)

( * ) Notice: Subject to any disclaimer, the term of this patent is extended or adjusted under 35 U.S.C. 154(b) by 0 days.

This patent is subject to a terminal disclaimer.

(21) Appl. No.: 15/795,135

(22) Filed: Oct. 26, 2017

(65) Prior Publication Data
US 2018/0169238 A1 Jun. 21, 2018

Related U.S. Application Data

(63) Continuation of application No. 15/680,187, filed on Aug. 17, 2017.

(60) Provisional application No. 62/513,771, filed on Jun. 1, 2017, provisional application No. 62/376,335, filed on Aug. 17, 2016, provisional application No. 62/417,217, filed on Nov. 3, 2016, provisional application No. 62/513,775, filed on Jun. 1, 2017, provisional application No. 62/477,974, filed on Mar. 28, 2017, provisional application No. 62/513,916, filed on Jun. 1, 2017, provisional application No. 62/538,561, filed on Jul. 28, 2017, provisional application No. 62/376,334, filed on Aug. 17, 2016.

(51) Int. Cl.
*A61K 39/395* (2006.01)
*C07K 16/28* (2006.01)
*A61K 39/00* (2006.01)

(52) U.S. Cl.
CPC .. *A61K 39/39558* (2013.01); *A61K 39/39541* (2013.01); *C07K 16/2803* (2013.01); *C07K 16/2818* (2013.01); *C07K 16/2827* (2013.01); A61K 2039/505 (2013.01); A61K 2039/507 (2013.01); C07K 2317/21 (2013.01); C07K 2317/24 (2013.01); C07K 2317/33 (2013.01); C07K 2317/34 (2013.01); C07K 2317/524 (2013.01); C07K 2317/526 (2013.01); C07K 2317/53 (2013.01); C07K 2317/56 (2013.01); C07K 2317/732 (2013.01); C07K 2317/76 (2013.01); C07K 2317/92 (2013.01); C07K 2319/035 (2013.01); C07K 2319/33 (2013.01)

(58) Field of Classification Search
None
See application file for complete search history.

(56) References Cited

U.S. PATENT DOCUMENTS

| | | | |
|---|---|---|---|
| 5,661,016 | A | 8/1997 | Lonberg |
| 8,431,350 | B2 | 4/2013 | Baldwin et al. |
| 9,499,596 | B2 | 11/2016 | Clark et al. |
| 9,695,238 | B2 | 7/2017 | Gao et al. |
| RE46,534 | E | 9/2017 | Baldwin et al. |
| 2004/0121370 | A1 | 6/2004 | Baldwin et al. |
| 2007/0037206 | A1 | 2/2007 | Rosen et al. |
| 2007/0054360 | A1 | 3/2007 | Gao et al. |
| 2007/0243584 | A1 | 10/2007 | West |
| 2009/0181024 | A1 | 7/2009 | Baldwin et al. |
| 2009/0258013 | A1 | 10/2009 | Clark et al. |
| 2011/0236903 | A1 | 9/2011 | McClellan et al. |
| 2014/0056890 | A1 | 2/2014 | Gurney et al. |
| 2016/0176963 | A1 | 6/2016 | Maurer et al. |
| 2016/0355589 | A1 | 12/2016 | Williams et al. |
| 2016/0376365 | A1 | 12/2016 | Gurney et al. |

(Continued)

FOREIGN PATENT DOCUMENTS

| | | |
|---|---|---|
| EP | 2 067 791 | 6/2009 |
| EP | 3208612 | 8/2017 |

(Continued)

OTHER PUBLICATIONS

Nosanchuk JD., The interdependence of antibody C and V regions on specificity and affinity: significant implications for the engineering of therapeutic antibodies., Virulence. Aug. 15, 2013;4(6):439-40. doi: 10.4161/viru.26153.

(Continued)

*Primary Examiner* — Mark Halvorson
(74) *Attorney, Agent, or Firm* — Robin M. Silva; Christina A. MacDougall; Morgan, Lewis & Bockius, LLP

(57) ABSTRACT

Anti-PVRIG and anti-TIGIT antibodies are provided.

20 Claims, 143 Drawing Sheets
Specification includes a Sequence Listing.

(56) References Cited

U.S. PATENT DOCUMENTS

| | | |
|---|---|---|
| 2017/0088613 A1 | 3/2017 | Grogan et al. |
| 2017/0145093 A1 | 5/2017 | Clark et al. |
| 2017/0198042 A1 | 7/2017 | Williams et al. |
| 2017/0240613 A1 | 8/2017 | Zhu et al. |

FOREIGN PATENT DOCUMENTS

| | | |
|---|---|---|
| WO | WO 2000/052151 | 9/2000 |
| WO | WO 2003/023013 | 3/2003 |
| WO | WO 2004/024068 A2 | 3/2004 |
| WO | WO 2004/030615 | 4/2004 |
| WO | WO 2004/058805 | 7/2004 |
| WO | WO 2005/016962 | 2/2005 |
| WO | WO 2005/019258 | 3/2005 |
| WO | WO 2006/124667 A2 | 11/2006 |
| WO | WO 2007/121364 A2 | 10/2007 |
| WO | WO 2007/124283 | 11/2007 |
| WO | WO 2008/021290 | 2/2008 |
| WO | WO 2009/126688 | 10/2009 |
| WO | WO 2011/109637 | 9/2011 |
| WO | WO 2012/031008 | 3/2012 |
| WO | WO 2012/129488 | 9/2012 |
| WO | WO 2012/156515 | 11/2012 |
| WO | WO 2012/178128 | 12/2012 |
| WO | WO 2013/184912 | 12/2013 |
| WO | WO 2015/009856 | 1/2015 |
| WO | WO 2016/028656 | 2/2016 |
| WO | WO 2016/081746 A2 | 5/2016 |
| WO | WO 2016/106302 | 6/2016 |
| WO | WO 2016/134333 | 8/2016 |
| WO | WO 2016/134335 | 8/2016 |
| WO | WO 2016/191643 A2 | 12/2016 |
| WO | WO 2016/196389 A1 | 12/2016 |
| WO | WO 2017/041004 | 3/2017 |
| WO | WO 2017/053748 A2 | 3/2017 |
| WO | WO 2017/059095 | 4/2017 |
| WO | WO 2017/021526 | 9/2017 |
| WO | WO 2018/017864 | 1/2018 |

OTHER PUBLICATIONS

Janda et al., Ig Constant Region Effects on Variable Region Structure and Function., Front Microbiol. Feb. 4, 2016;7:22. doi: 10.3389/fmicb.2016.00022. eCollection 2016.

Gene ID: PVRIG antibody—middle region, Rabbit Polyclonal Antibody Catalog #Al13083, retrieved from the internet: URL:http://www.funakoshi.co.jp/data/datasheet/ABG/Al1308.pdf.

Stanietsky et al., The interaction of TIGIT with PVR and PVRL2 inhibits human NK cell cytotoxicity., Proc Natl Acad Sci U S A. Oct. 20, 2009;106(42):17858-63.

Yu et al., The surface protein TIGIT suppresses T cell activation by promoting the generation of mature immunoregulatory dendritic cells., Nat Immunol. Jan. 2009;10(1):48-57.

Zhu et al., Identification of CD112R as a novel checkpoint for human T cells., J Exp Med. Feb. 8, 2016;213(2):167-76.

Rotman et al., Identification of novel immune checkpoints as targets for cancer immunotherapy., J Immunother Cancer. 2013; 1(Suppl 1): P135.

Johnston et al., The immunoreceptor TIGIT regulates antitumor and antiviral CD8(+) T cell effector function., Cancer Cell. Dec. 8, 2014;26(6):923-37.

Orentas et al., Bioinformatic description of immunotherapy targets for pediatric T-cell leukemia and the impact of normal gene sets used for comparison., Front Oncol. Jun. 10, 2014;4:134.

Quinones et al., 2205 High-throughput cellular assays using a well-less plate format. Genentech, South San Francisco, CA, Curiox Biosystems, Singapore, New Technologies and Frontiers, Dec. 6, 2011.

He et al., Remarkably similar CTLA-4 binding properties of therapeutic ipilimumab and tremelimumab antibodies., Oncotarget. May 19, 2017;8(40):67129-67139. doi: 10.18632/oncotarget.18004. eCollection Sep. 15, 2017.

Scott et al., Antibody therapy of cancer., 2012, Nature Reviews, vol. 12: 278-287.

Weiner et al., Antibody-based immunotherapy of cancer., Cell. Mar. 16, 2012;148(6):1081-4. doi: 10.1016/j.cell.2012.02.034.

FIG. 1

Human PVRIG WT Full length

Human PVRIG sequence starting from position 21 - alternative methionine

<u>MGHRTLVLPWVLLTLCVTAGTPEVWVQVRMEATELSSFTIRCGFLGSGSISLVTVSWGGPNGAGGTTLAVLHPERGIR</u>
<u>QWAPARQARWETQSSISLILEGSGASSPCANTTFCCKFASFPEGSWEACGSLPPSSDPGLSAPPTPAPILRAD</u>LAGILGV
SGVLLFGCVYLLHLLRRHKHRPAPRLQPSRTSPQAPRARAWAPSQA

(SEQ ID NO: 1)

Human PVRIG sequence starting from position 1 methionine

<u>MRTEAQVPALQPPEPGLEGAMGHRTLVLPWVLLTLCVTAGTPEVWVQVRMEATELSSFTIRCGFLGSGSISLVTVSWG</u>
<u>GPNGAGGTTLAVLHPERGIRQWAPARQARWETQSSISLILEGSGASSPCANTTFCCKFASFPEGSWEACGSLPPSSDPG</u>
<u>LSAPPTPAPILRAD</u>LAGILGVSGVLLFGCVYLLHLLRRHKHRPAPRLQPSRTSPQAPRARAWAPSQA

(SEQ ID NO: 2)

transmembrane protein PVRIG [Homo sapiens]

NCBI Reference Sequence: NP_076975

1 mrteaqvpal qppepglega mghrtlvlpw vlltlcvtag tpevwvqvrm eatelssfti 61 rcgflgsgsi slvtvswggp ngaggttlav lhpergirqw aparqarwet qssislileg 121 sgasspcant tfcckfasfp egsweacgsl ppssdpglsa pptpapilra dlagilgvsg 181 vllfgcvyll hllrrhkhrp aprlqpsrts pqaprarawa psqasqaalh vpyatintsc 241 rpatldtahp hggpswwasl pthaahrpqg paawastpip argsfvsven glyaqagerp 301 phtgpgltlf pdprgprame gplgvr

(SEQ ID NO: 612)

FIG. 2

Human PVR2 alpha isoform
>gi|5360210|ref|NP_002847.1| nectin-2 isoform alpha precursor [Homo sapiens]
MARAAALLPSRSPPTPLLWPLLLLLLLETGAQDVRVQVLPEVRGQLGGTVELPCHLPPVPGLYISLVTW
QRPDAPANHQNVAAFHPKMGPSFPSPKPGSERLSFVSAKQSTGQDTEAELQDATLALHGLTVEDEGNYTC
EFATFPKGSVRGMTWLRVIAKPKNQAEAQKVTFSQDPTTVALCISKEGRPPARISWLSSLDWEAKETQVS
GTLAGTVTVTSRFTLVPSGRADGVTVTCKVEHESFEEPALIPVTLSVRYPPEVSISGYDDNWYLGRTDAT
LSCDVRSNPEPTGYDWSTTSGTFPTSAVAQGSQLVIHAVDSLFNTTFVCTVTNAVGMGRAEQVIFVRETP
RASPRDVGPLVGAVGGTLLVLLLLAGGSLAFILLRVRRRKSPGGAGGGASGDGGFYDPKAQVLGNGDP
VFWTPVVPGPMEPDGKDEEEEEEEEKAEKGLMLPPPPALEDDMESQLDGSLISRRAVYV (SEQ ID NO:3)

Human PVR2 delta isoform
>gi|112789532|ref|NP_001036189.1| nectin-2 isoform delta precursor [Homo sapiens]
MARAAALLPSRSPPTPLLWPLLLLLLLETGAQDVRVQVLPEVRGQLGGTVELPCHLPPVPGLYISLVTW
QRPDAPANHQNVAAFHPKMGPSFPSPKPGSERLSFVSAKQSTGQDTEAELQDATLALHGLTVEDEGNYTC
EFATFPKGSVRGMTWLRVIAKPKNQAEAQKVTFSQDPTTVALCISKEGRPPARISWLSSLDWEAKETQVS
GTLAGTVTVTSRFTLVPSGRADGVTVTCKVEHESFEEPALIPVTLSVRYPPEVSISGYDDNWYLGRTDAT
LSCDVRSNPEPTGYDWSTTSGTFPTSAVAQGSQLVIHAVDSLFNTTFVCTVTNAVGMGRAEQVIFVRETP
NTAGAGATGGIIGGIIAAIIATAVAATGILICRQQRKEQTLQGAEEDEDLEGPPSYKPPTPKAKLEAQEM
PSQLFTLGASEHSPLKTPYFDAGASCTEQEMPRYHELPTLEERSGPLHPGATSLGSPIPVPPGPPAVEDV
SLDLEDEEGEEEEEYLDKINPIYDALSY (SEQ ID NO:4)

Figure 3A

CHA.7.518.1.H4(S241P)

| What | sequence | SEQ ID NO: |
|---|---|---|
| Variable heavy (vh) domain | QVQLVQSGAEVKKPGASVKVSCKASGYTFTDYNINWVRQAPGQGLEWMGYIYPYIGGSGYAQKFQGRVTMTRDTSTSTVYME LSSLRSEDTAVYYCAREDKTARNAMDYWGQGTLVTVSS | 5 |
| vhCDR1 | GYTFTDYN | 6 |
| vhCDR2 | IYPYIGGS | 7 |
| vhCDR3 | AREDKTARNAMDY | 8 |
| Full length HC | QVQLVQSGAEVKKPGASVKVSCKASGYTFTDYNINWVRQAPGQGLEWMGYIYPYIGGSGYAQKFQGRVTMTRDTSTSTVYME LSSLRSEDTAVYYCAREDKTARNAMDYWGQGTLVTVSSASTKGPSVFPLAPCSRSTSESTAALGCLVKDYFPEPVTVSWNSGALT SGVHTFPAVLQSSGLYSLSSVVTVPSSSLGTKTYTCNVDHKPSNTKVDKRVESKYGPPCPCPAPEFLGGPSVFLFPPKPKDTLMISR TPEVTCVVVDVSQEDPEVQFNWYVDGVEVHNAKTKPREEQFNSTYRVVSVLTVLHQDWLNGKEYKCKVSNKGLPSSIEKTISKA KGQPREPQVYTLPPSQEEMTKNQVSLTCLVKGFYPSDIAVEWESNGQPENNYKTTPPVLDSDGSFFLYSRLTVDKSRWQEGNVF SCSVMHEALHNHYTQKSLSLSPGK | 9 |
| Variable light (vl) domain | DIQMTQSPSSLSASVGDRVTITCRVSENIYSNLAWYQQKPGKAPKLLIYEATNLAEGVPSRFSGSGSGTDFTLTISSLQPEDFATYYC QHFWGTPYTFGQGTKLEIK | 10 |
| vlCDR1 | ENIYSN | 11 |
| vlCDR2 | EAT | 12 |
| vlCDR3 | QHFWGTPYT | 13 |
| Full length light chain | DIQMTQSPSSLSASVGDRVTITCRVSENIYSNLAWYQQKPGKAPKLLIYEATNLAEGVPSRFSGSGSGTDFTLTISSLQPEDFATYYC QHFWGTPYTFGQGTKLEIKRTVAAPSVFIFPPSDEQLKSGTASVVCLLNNFYPREAKVQWKVDNALQSGNSQESVTEQDSKDSTY SLSSTLTLSKADYEKHKVYACEVTHQGLSSPVTKSFNRGEC | 14 |

Figure 3B

CHA.7.538.1.2.H4(S241P)

| What | sequence | SEQ ID NO: |
|---|---|---|
| Variable heavy (vh) domain | QVQLVQSGAEVKKPGASVKVSCKASGYAFTNYLIEWVRQAPGQGLEWIGVINPGSGGIYYAQKFQGRVTMTADTSTSTVYME LSSLRSEDTAVYYCARSETHDTWFAYWGQGTLVTVSS | 15 |
| vhCDR1 | GYAFTNYL | 16 |
| vhCDR2 | INPGSGGI | 17 |
| vhCDR3 | ARSETHDTWFAY | 18 |
| Full length HC | QVQLVQSGAEVKKPGASVKVSCKASGYAFTNYLIEWVRQAPGQGLEWIGVINPGSGGIYYAQKFQGRVTMTADTSTSTVYME LSSLRSEDTAVYYCARSETHDTWFAYWGQGTLVTVSSASTKGPSVFPLAPCSRSTSESTAALGCLVKDYFPEPVTVSWNSGALTS GVHTFPAVLQSSGLYSLSSVVTVPSSSLGTKTYTCNVDHKPSNTKVDKRVESKYGPPCPPCPAPEFLGGPSVFLFPPKPKDTLMISR TPEVTCVVVDVSQEDPEVQFNWYVDGVEVHNAKTKPREEQFNSTYRVVSVLTVLHQDWLNGKEYKCKVSNKGLPSSIEKTISKA KGQPREPQVYTLPPSQEEMTKNQVSLTCLVKGFYPSDIAVEWESNGQPENNYKTTPPVLDSDGSFFLYSRLTVDKSRWQEGNV FSCSVMHEALHNHYTQKSLSLSPGK | 19 |
| Variable light (vl) domain | DIQMTQSPSSLSASVGDRVTITCKASQSVRIAVAWFQQKPGKAPKALIYLASTRHTGVPSRFSGSGSGTDFTLTISSVQPEDFATY YCLQHWNYPYTFGQGTKLEIK | 20 |
| vlCDR1 | QSVRIA | 21 |
| vlCDR2 | LAS | 22 |
| vlCDR3 | LQHWNYPYT | 23 |
| Full length light chain | DIQMTQSPSSLSASVGDRVTITCKASQSVRIAVAWFQQKPGKAPKALIYLASTRHTGVPSRFSGSGSGTDFTLTISSVQPEDFATY YCLQHWNYPYTFGQGTKLEIKRTVAAPSVFIFPPSDEQLKSGTASVVCLLNNFYPREAKVQWKVDNALQSGNSQESVTEQDSKD STYSLSSTLTLSKADYEKHKVYACEVTHQGLSSPVTKSFNRGEC | 24 |

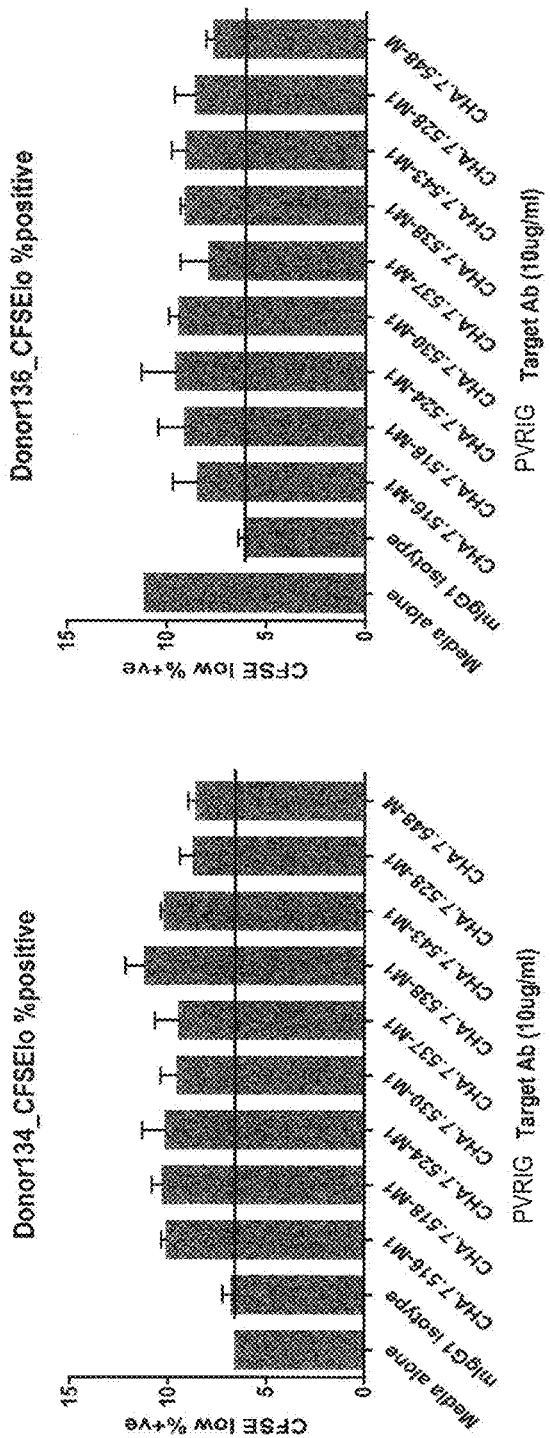

FIG. 5A

| Antibody (mIgG) | $EC_{50}$ (HEK OE, nM) | HEK OE/par (3.3ug/ml, gMFIr) | Jurkat (3.3ug/ml, gMFIr) |
|---|---|---|---|
| CHA.7.502 | 40.18 | 71.99 | 6.21 |
| CHA.7.503 | 1.05 | 260.98 | 23.59 |
| CHA.7.506 | No binding | 0.76 | No binding |
| CHA.7.508 | 3.30 | 45.86 | 6.50 |
| CHA.7.510 | 92.81 | 16.32 | 4.19 |
| CHA.7.512 | 52.99 | 5.12 | 1.47 |
| CHA.7.514 | 5.31 | 49.82 | 7.67 |
| CHA.7.516 | 0.79 | 37.90 | 5.73 |
| CHA.7.518 | 0.36 | 42.24 | 6.58 |
| CHA.7.520 | No binding | 1.01 | No binding |
| CHA.7.522 | 91.44 | 10.12 | 2.99 |
| CHA.7.524 | 0.46 | 48.33 | 7.87 |
| CHA.7.525 | 3.05 | 41.86 | 4.30 |
| CHA.7.526 | 2.99 | 47.28 | 3.98 |
| CHA.7.527 | No binding | 0.98 | No binding |
| CHA.7.528 | 7.31 | 44.88 | 6.17 |
| CHA.7.530 | 0.33 | 51.14 | 8.04 |
| CHA.7.534 | 1.87 | 43.72 | 5.05 |
| CHA.7.535 | 3.67 | 40.44 | 2.79 |
| CHA.7.537 | 2.47 | 36.61 | 5.53 |

FIG. 5B

| | | | |
|---|---|---|---|
| CHA.7.538 | 0.52 | 35.80 | 7.37 |
| CHA.7.543 | 0.52 | 49.81 | 6.73 |
| CHA.7.544 | 0.76 | 42.60 | 5.68 |
| CHA.7.545 | 0.76 | 44.31 | 6.53 |
| CHA.7.546 | 0.61 | 43.14 | 6.42 |
| CHA.7.547 | 14.37 | 10.94 | 1.02 |
| CHA.7.548 | 0.27 | 45.26 | 7.37 |
| CHA.7.549 | 2.60 | 29.71 | 2.23 |
| CHA.7.550 | 1.34 | 27.72 | 2.10 |

FIG. 6A

| Antibody (mIgG) | Human CD56 int. NK (gMFIr, 10ug/ml) | Human CD8+ T cells (gMFIr, 10ug/ml) | Expi cyno OE/par (gMFIr, 3.3ug/ml) | Cyno NK cells (gMFIr, 10ug/ml) | Cyno CD8+ T cells (gMFIr, 10ug/ml) |
|---|---|---|---|---|---|
| CHA.7.502 | 1.97 | 1.41 | 60.49 | Not tested | Not tested |
| CHA.7.503 | 3.15 | 1.96 | 106.3 | Not tested | Not tested |
| CHA.7.506 | Not tested | Not tested | 0.77 | Not tested | Not tested |
| CHA.7.508 | 3.6 | 4.09 | 41.49 | Not tested | Not tested |
| CHA.7.510 | 3.13 | 2.73 | 38.21 | Not tested | Not tested |
| CHA.7.512 | 1.30 | 1.15 | 8.96 | Not tested | Not tested |
| CHA.7.514 | 4.16 | 5.15 | 65.20 | Not tested | Not tested |
| CHA.7.516 | 4.22 | 4.09 | 60.05 | 1.76 | 2.09 |
| CHA.7.518 | 5.08 | 6.69 | 83.51 | 1.92 | 2.09 |
| CHA.7.520 | 1.13 | 1.04 | Not tested | Not tested | Not tested |
| CHA.7.522 | 2.06 | 1.90 | 27.24 | Not tested | Not tested |

FIG. 6B

| | | | | | |
|---|---|---|---|---|---|
| CHA.7.524 | 5.50 | 6.12 | 66.32 | 1.78 | 2.02 |
| CHA.7.525 | 1.98 | 1.76 | 0.85 | Not tested | Not tested |
| CHA.7.526 | 2.08 | 1.71 | 0.79 | Not tested | Not tested |
| CHA.7.527 | 1.16 | 0.99 | Not tested | Not tested | Not tested |
| CHA.7.528 | 3.08 | 3.63 | 12.2 | 1.21 | 1.18 |
| CHA.7.530 | 6.04 | 6.47 | 60.80 | 1.73 | 1.89 |
| CHA.7.534 | 2.60 | 1.96 | 46.27 | Not tested | Not tested |
| CHA.7.535 | 2.24 | 1.28 | 0.82 | Not tested | Not tested |
| CHA.7.537 | 3.90 | 3.41 | 1.55 | 1.18 | 1.19 |
| CHA.7.538 | 6.49 | 6.17 | 15.16 | 1.36 | 1.45 |
| CHA.7.543 | 4.48 | 4.33 | 0.83 | 1.35 | 1.39 |
| CHA.7.544 | 2.36 | 2.54 | 61.09 | Not tested | Not tested |
| CHA.7.545 | 2.54 | 2.82 | 0.91 | Not tested | Not tested |
| CHA.7.546 | 2.75 | 2.95 | 0.85 | Not tested | Not tested |
| CHA.7.547 | 2.21 | 1.13 | 26.65 | Not tested | Not tested |
| CHA.7.548 | 3.15 | 3.35 | 4.25 | 1.18 | 1.09 |
| CHA.7.549 | 3.05 | 1.42 | 1.00 | Not tested | Not tested |
| CHA.7.550 | 1.60 | 1.29 | 0.90 | Not tested | Not tested |

FIG. 7A

| Antibody (mIgG) | $IC_{50}$ (nM) |
|---|---|
| CHA.7.502 | 39.90 |
| CHA.7.503 | No $IC_{50}$ |
| CHA.7.506 | 31.65 |
| CHA.7.508 | 37.88 |
| CHA.7.510 | 55.00 |
| CHA.7.512 | 839.6 |
| CHA.7.514 | 38.88 |
| CHA.7.516 | 33.11 |
| CHA.7.518 | 23.15 |
| CHA.7.520 | 619.3 |
| CHA.7.522 | 50.48 |
| CHA.7.524 | 30.20 |
| CHA.7.525 | 85.52 |
| CHA.7.526 | 58.88 |
| CHA.7.527 | No $IC_{50}$ |
| CHA.7.528 | 28.88 |
| CHA.7.530 | 34.56 |
| CHA.7.534 | 181.4 |
| CHA.7.535 | 821.1 |
| CHA.7.537 | 38.95 |
| CHA.7.538 | 51.87 |
| CHA.7.543 | No $IC_{50}$ |

FIG. 7B

| | |
|---|---|
| CHA.7.544 | No IC$_{50}$ |
| CHA.7.545 | 96.06 |
| CHA.7.546 | 92.05 |
| CHA.7.547 | 27.94 |
| CHA.7.548 | 18.98 |
| CHA.7.549 | 36.12 |
| CHA.7.550 | 58.34 |

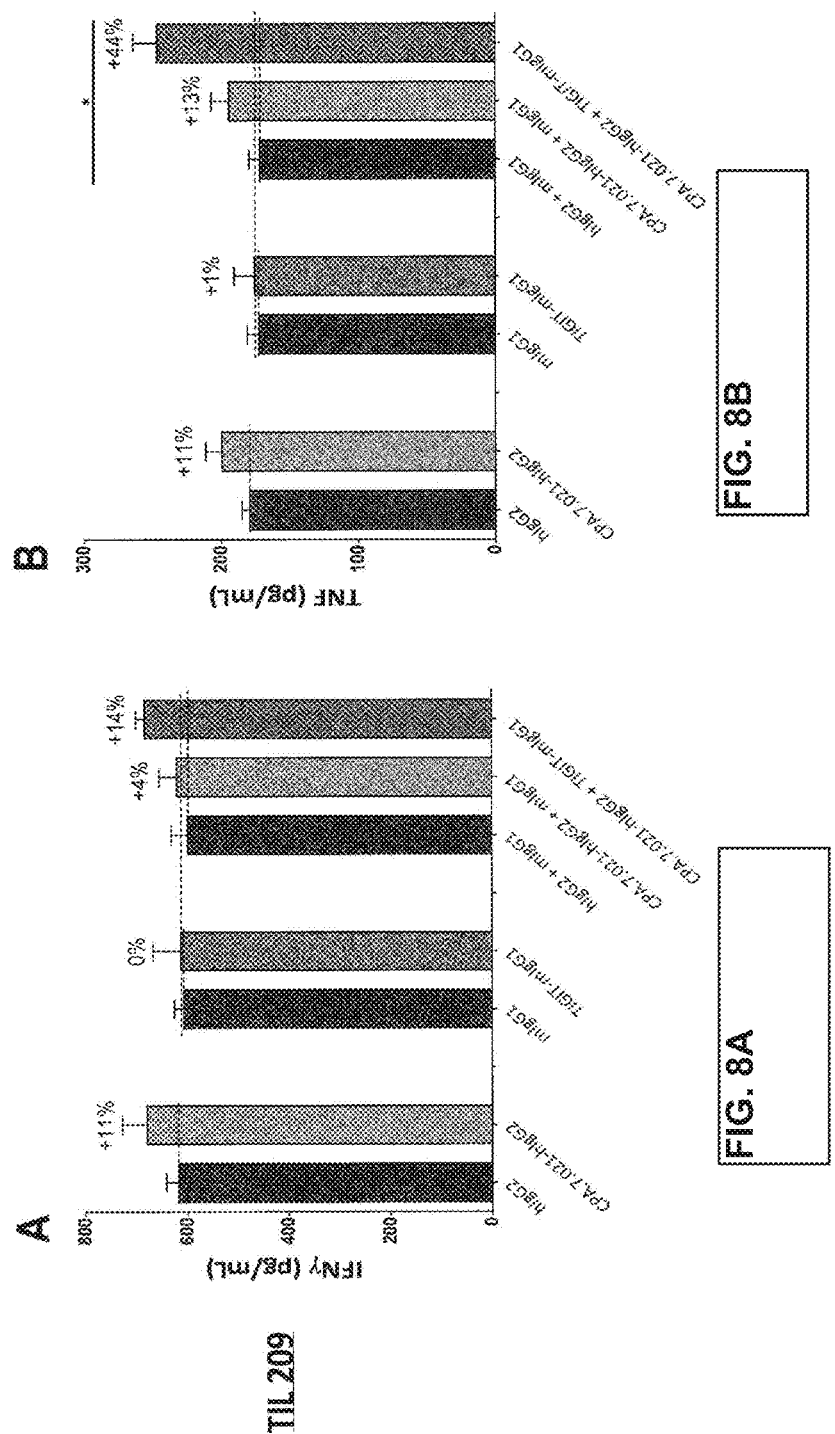

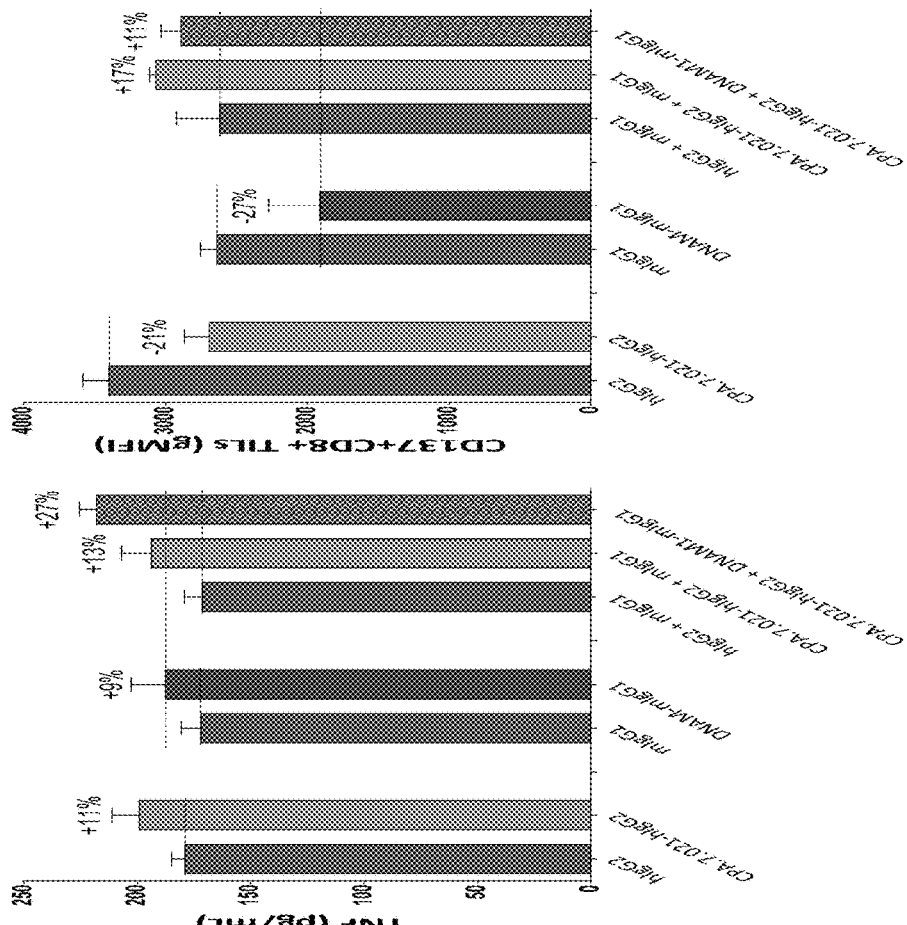
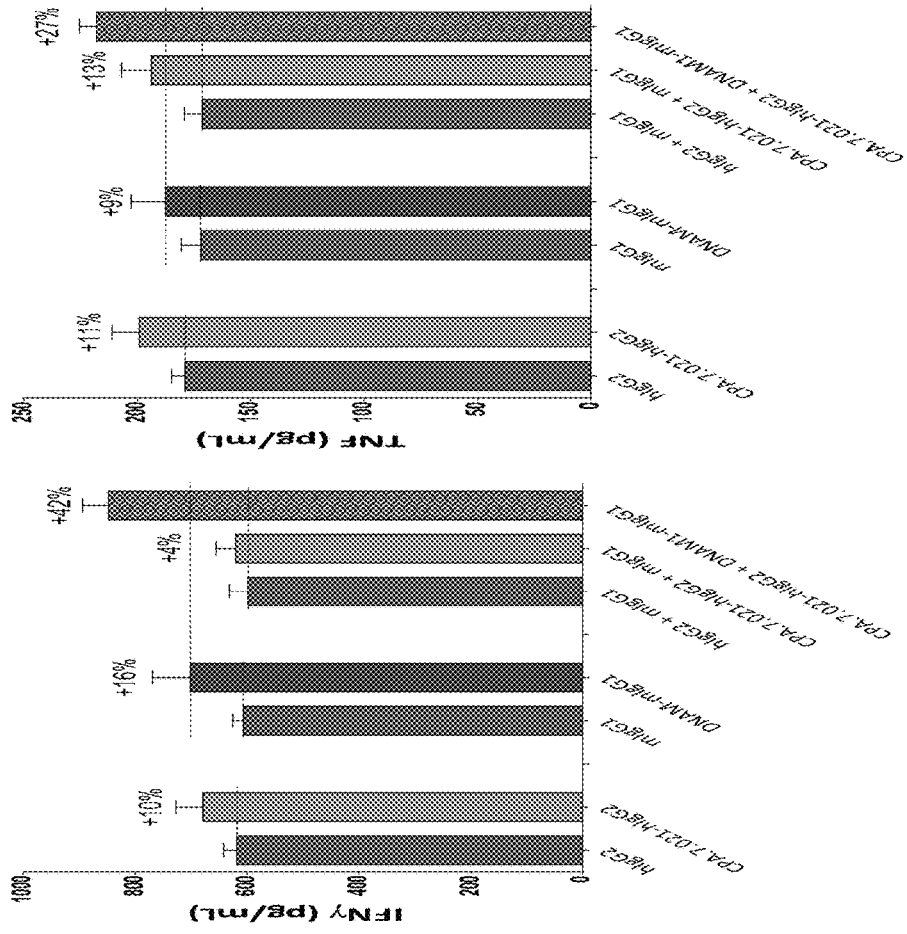
FIG. 9A  FIG. 9B  FIG. 9C

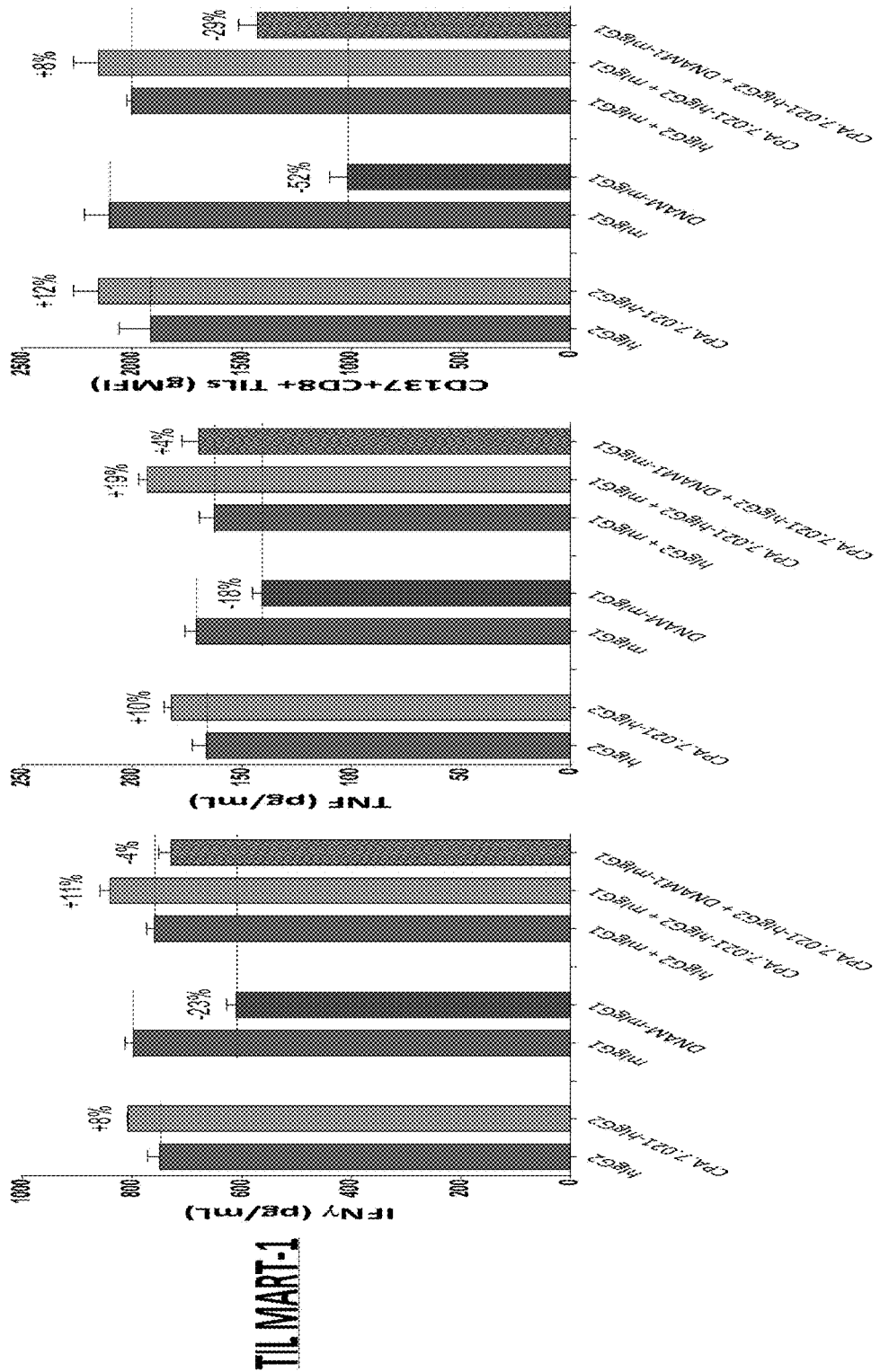

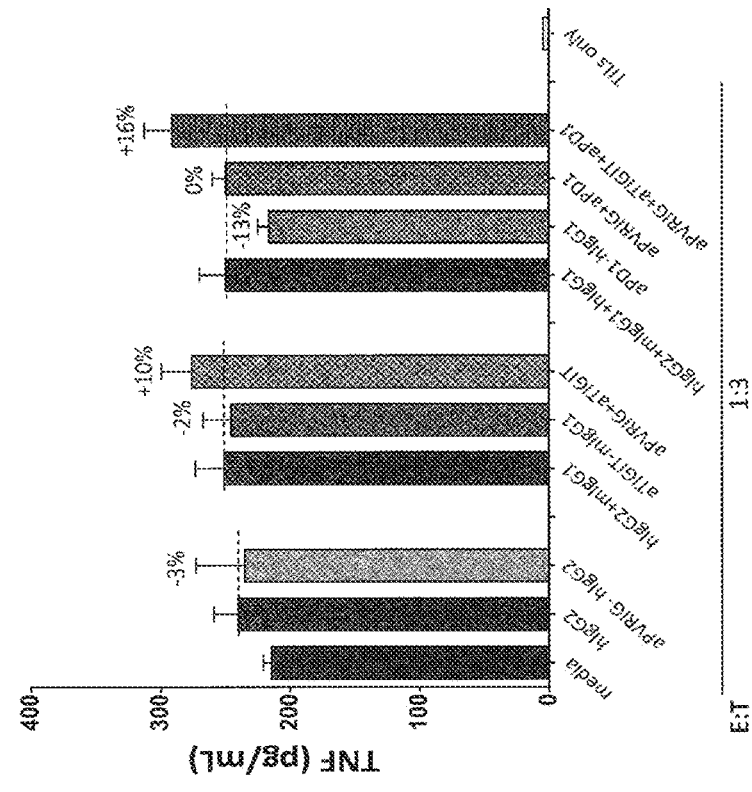
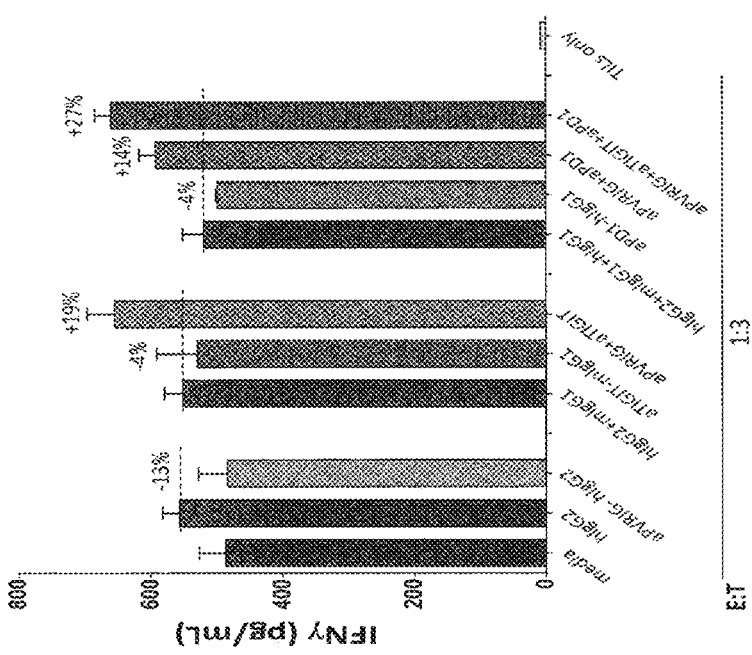

FIG. 11A

Humanized sequences of CHA.7.518 antibody VH

Potential humanized sequence based on IMGT IGHV1-46*01 acceptor framework (AbM CDR definition)

IGHV1-46*01  QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR
(SEQ ID NO: 25)

Joining region  IMGT J00256|IGHJ4*01|YFDYWGQGTLVTVSS (SEQ ID NO: 26 )

```
seq              10         20         30         40         50        60         70         80        90
AbM              b b b      p  p b b b  b b b      b b i     i ibb b    i  b     b b b b z    b b  b    bibibb
518     EVQLQQSGPELVKPGASVKISCKAS GYTFTDYNIN WVKQSHGKSLEWIG YIYPYIGGSG YNQKFKGKATLSADNPSSTAYMQLSSLTSEDTAVYYCAR
        *                                  *  * ***                                *      *       *****

1-46*01 QVQLVQSGAEVKKPGASVKVSCKAS GYTFTSYYMH  WVRQAPGQGLEWMG IINPSGGSTS  YAQKFQGRVTMTRDTSTSTVYMELSSLRSEDTAVYYCAR
h518H1  QVQLVQSGAEVKKPGASVKVSCKAS GYTFTDYNIN  WVRQAPGQGLEWMG YIYPYIGGSG  YAQKFQGRVTMTRDTSTSTVYMELSSLRSEDTAVYYCAR
h518H2  QVQLVQSGAEVKKPGASVKVSCKAS GYTFTDYNIN  WVRQAPGQGLEWIG YIYPYIGGSG  YAQKFQGRVTMTRDTSTSTVYMELSSLRSEDTAVYYCAR
h518H3  QVQLVQSGAEVKKPGASVKISCKAS GYTFTDYNIN  WVRQAPGQGLEWIG YIYPYIGGSG  YAQKFQGRVTMTADTSTSTVYMELSSLRSEDTAVYYCAR
h518H4  QVQLVQSGAEVKKPGASVKISCKAS GYTFTDYNIN  WVRQAPGQGLEWIG YIYPYIGGSG  YAQKFQGRATLTADWSTAYMELSSLRSEDTAVYYCAR
                 V                    #                                             N seq            100         110        120
AbM                        i  b b b
518     EDKTARNAMDY WGQGTPVTVSS (SEQ ID NO: 27 )
                 *          (1-46*01 disclosed as SEQ ID NO: 28 )
h518H1  EDKTARNAMDY WGQGTLVTVSS (SEQ ID NO: 29 )
h518H2  EDKTARNAMDY WGQGTLVTVSS (SEQ ID NO: 30 )
h518H3  EDKTARNAMDY WGQGTLVTVSS (SEQ ID NO: 31 )
h518H4  EDKTARNAMDY WGQGTLVTVSS (SEQ ID NO: 32 )
             #
``` deamidation substitutions: Q/S/A

FIG. 11B

Humanized sequences of CHA.7.518 antibody VL

Potential humanized sequence based on IMGT IGKV1-39*01 acceptor framework

```
IGKV1-39*01
DIQMTQSPSSLSASVGDRVTITCRASQSISSYLNWYQQKPGKAPKLLIYAASSLQSGVPSRFSGSGSGTDFTLTISSLQPEDFATYYCQQSYSTPP (SEQ ID NO: 33)

Joining region IMGT J00242|IGKJ2*01|YTFGQGTKLEIK (SEQ ID NO: 34   )

10              20              30              40              50              60              70              80
seq            10              20              30              40              50              60              70              80
AbM          b b b           p p p   b b b      b b   bi bi i    ii bbbi          i   bbbi          b  b      b b b          ib bib
518         DIQMTQSPASLSASVSVGETYTIIC RVSENIYSNLA WYQQKQGKSPQLLVY EATNLAE         GVPSRFSGSGSGTQYSLKINSLQSEDFGSYYC
               *                * *    #           *   * *         #                                ***  *   *      *        *    **
                                V                  S                             S
IGKV1-39    DIQMTQSPSSLSASVGDRVTITC  RASQSISSYLN  WYQQKPGKAPKLLIY AASSLQS         GVPSRFSGSGSGTDFTLTISSLQPEDFATYYC
h518L1      DIQMTQSPSSLSASVGDRVTITC  RVSENIYSNLA  WYQQKPGKAPKLLIY EATNLAE         GVPSRFSGSGSGTDFFLTISSLQPEDFATYYC
h518L2      DIQMTQSPSSLSASVGDRVTITC  RVSENIYSNLA  WYQQKPGKAPKLLIY EATNLAE         GVPSRFSGSGSGTDYTLTISSLQPEDFATYYC
h518L3      DIQMTQSPSSLSASVGDRVTITC  RVSENIYSNLA  WYQQKPGKAPKLLVY EATNLAE         GVPSRFSGSGSGTDYTLTISSLQPEDFGTYYC
                                        #              *           #                                  *                         *

90              100
seq            90              100
AbM          ibi  iib  i   b b b
518         QHFWGTPYT       FGGGTKLEIK (SEQ ID NO: 35)
              @

IGKV1-39    QQSYSTPP        FGQGTKLEIK (SEQ ID NO: 36)
h518L1      QHFWGTPYT       FGGGTKLEIK (SEQ ID NO: 37)
h518L2      QHFWGTPYT       FGGGTKLEIK (SEQ ID NO: 38)
h518L3      QHFWGTPYT       FGGGTKLEIK (SEQ ID NO: 39)
              @
```

\# deamidation substitutions: Q/S/A/D
@ tryptophan oxidation substitutions: Y/F/H

FIG. 11C

Humanized sequences of CHA.7.538_1 antibody VH

Potential humanized sequence based on IMGT IGHV1-46*01 acceptor framework
IGHV1-46*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR (SEQ ID NO: 40)

Joining region    IMGT J00256|IGHJ4*01|YFDYWGQGTLVTVSS (SEQ ID NO: 41 )

```
                         10         20         30         40         50         60         70         80      abc   90
seq                      10         20         30         40         50         60         70         80            90
AbM             b b b           b b b b       b b    b i  ibb b  b i     i ibb b  i  b        b b b x      b b b b      bibibb
538_1           QVQLQQSGAELVRPGASVKVSCKASGYTFTSYYMHWVKQRPGQGLEWIGVINPGSGGTYNDKFKVKTTLTADKSSTAYMQLSSLTSDDSAVYYCAR
                *                    *                *      *    *  *                   *    *    * ***   *  *  *  *   *

1-46*01         QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR
h5381H1         QVQLVQSGAEVKKPGASVKVSCKASGYAFTNYLIEWVRQAPGQGLEWMGVINPGSGGIYYAQKFQGRVTMTRDTSTSTVYMELSSLRSEDTAVYYCAR
h5381H2         QVQLVQSGAEVKKPGASVKVSCKASGYAFTNYLIEWVRQAPGQGLEWIGVINPGSGGIYYAQKFQGRVTMTKDTSTSTVYMELSSLRSEDTAVYYCAR
h5381H3         QVQLVQSGAEVKKPGASVKVSCKASGYAFTNYLIEWVRQAPGQGLEWIGVINPGSGGIYYAQKFQGRVTMTADTSTSTAIMELSSLRSEDTAVYYCAR
h5381H4         QVQLVQSGAEVKKPGASVKVSCKTSGYAFTNYLIEWVRQAPGQGLEWIGVINPGSGGIYYAQKFQGRVTLTADKSTSTAIMELSSLRSEDTAVYYCAR
                                 V                     #                     #                  N T                          F 100        110
seq                      100        110
AbM                                i   b b b
538_1           SETHDTWFAY WGQGTLVTVSA (SEQ ID NO: 42 )
                    @                  *      (1-46*01 disclosed as SEQ ID NO: 44 )
h5381H1         SETHDTWFAY WGQGTLVTVSS (SEQ ID NO: 45 )
h5381H2         SETHDTWFAY WGQGTLVTVSS (SEQ ID NO: 46 )
h5381H3         SETHDTWFAY WGQGTLVTVSS (SEQ ID NO: 47 )
h5381H4         SETHDTWFAY WGQGTLVTVSS
``` deamidation substitutions: Q/S/A
@ tryptophan oxidation substitutions: Y/F/H

FIG. 11D humanized sequences of CHA.7.538_1 antibody VL

Potential humanized sequence based on IMGT IGKV1-39*01 acceptor framework
IGKV1-39*01:
DIQMTQSPSSLSASVGDRVTITCRASQSISSYLNWYQQKPGKAPKLLIYAASSLQSGVPSRFSGSGSGTDFTLTISSLQPEDFATYYCQQSYSTPP (SEQ ID NO:48)

Joining region IMGT J00242|IGKJ2*01|YTFGQGTKLEIK (SEQ ID NO:49 )

IGKV1-17*02
DIQMTQSPSSLSASVGDRVTITCRASQGIRNDLGWYQQKPGKAPKRLIYAASSLQSGVPSRFSGSGSGTEFTLTISNLQPEDFATYYCLQHNSYPP (SEQ ID NO: 50)

```
seq              10         20         30         40         50         60         70         80
AbM              bbb       p p        b b      bi ibbi   i ibbi     b b       b       bib bib
538         DIVMTQSQKFISTSVGDRVSITC KASQSVRIAVA WFQQKPGQSPKALIY LASTRHT GVPDRFTGSGSGTDFTLTISNVQSEDLADYFC
                 ****                *          *               *           *             y    *
IGKV1-39    DIQMTQSPSSLSASVGDRVTITC RASQSISSYLN WYQQKPGKAPKLLIY AASSLQS GVPSRFSGSGSGTDFTLTISSLQPEDFATYYC
h538L1      DIQMTQSPSSLSASVGDRVTITC KASQSVRIAVA WYQQKPGKAPKLLIY LASTRHT GVPSRFSGSGSGTDFTLTISSLQPEDFATYYC
h538L2      DIQMTQSPSSLSASVGDRVTITC KASQSVRIAVA WFQQKPGKAPKALIY LASTRHT GVPSRFSGSGSGTDFTLTISSVQPEDFATYYC
                 I  T                              S                                             L   F seq              90        100
AbM              ibi iib  i   b b b
538         LQHWNYPYT FGGGTKLEIK (SEQ ID NO: 51 )
                 @#
IGKV1-39    QQSYSTPP         (SEQ ID NO:52 )
h538L1      LQHWNYPYT FGQGTKLEIK (SEQ ID NO:53 )
h538L2      LQHWNYPYT FGQGTKLEIK (SEQ ID NO:54 )
```

\# deamidation substitutions: Q/S/A/D
@ tryptophan oxidation substitutions: Y/F/H

FIG. 11E humanized sequences of CHA.7.538_2 antibody VH

Potential humanized sequence based on IMGT IGHV1-46*01 acceptor framework
IGHV1-46*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR (SEQ ID NO:55)

Joining region
IMGT J00256|IGHJ4*01|YFDYWGQGTLVTVSS (SEQ ID NO:56 )

```
              10         20         30         40         50         60         70         80         90
              10         20         30         40         50         60         70       80  abc        90
seq       b b b       p       b b b       b b b    b b i  i ibb b    a    b  b i i  b b b x  b b b b   bibibb
AbM           *           ***           *          * *  *  *         * * * *         * * * * * *         *
538_2     QVQLQQSGAELVRPGTSVKMSCKAAGYTFTSYYMHWVKQRPGHGLEWIGDIYPGGGYTNYNEKFKGKATLTADTSSSTAYMQLSSLTSEDSAIYYCAS
                                                                                                       i
                         V
1-46*01   QVQLVQSGAEVKKPGASVKVSCKASGYTFTSYYMHWVRQAPGQGLEWMGIINPSGGSTS YAQKFQGRVTMTRDTSTSTVYMELSSLRSEDTAVYYCAR
h5382H1   QVQLVQSGAEVKKPGASVKVSCKASGYTFTNYWIGWVRQAPGQGLEWIGDIYPGGGYTN YAQKFQGRVTMTRDTSTSTVYMELSSLRSEDTAVYYCAS
h5382H2   QVQLVQSGAEVKKPGASVKVSCKASGYTFTNYWIGWVRQAPGQGLEWIGDIYPGGGYTN YAQKFQGRVTMTADTSTSTVYMELSSLRSEDTAVYYCAS
h5382H3   QVQLVQSGAEVKKPGASVKMSCKASGYTFTNYWIGWVRQAPGQGLEWIGDIYPGGGYTN YAQKFQGRATLTADTSTSTAYMELSSLRSEDTAVYYCAS
                        #  @                                          N 100        110
              100        110
seq                   i    b b b
AbM
538_2     PYYGSSYGFAF WGQGTLVTVSA (SEQ ID NO:57 )
                              *  (1-46*01 disclosed as SEQ ID NO:58 )
h5382H1   PYYGSSYGFAF WGQGTLVTVSS (SEQ ID NO:59 )
h5382H2   PYYGSSYGFAF WGQGTLVTVSS (SEQ ID NO:60 )
h5382H3   PYYGSSYGFAF WGQGTLVTVSS (SEQ ID NO:61 )
```

\# deamidation substitutions: Q/S/A
@ tryptophan oxidation substitutions: Y/F/H

Figure 12A

| What | Sequences |
|---|---|
| humanized CHA.7.518 VH h518HH1 | QVQLVQSGAEVKKPGASVKVSCKASGYTFTDYNINWVRQAPGQGLEWMGYIYPYIGGSGYAQKFQGRVTMTRDTSTSTVYMELSSLRSEDTAVYYCAREDKTARNAMDYWGQGTLVTVSS (SEQ ID NO:62) |
| humanized CHA.7.518 VH h518HH2 | QVQLVQSGAEVKKPGASVKVSCKASGYTFTDYNINWVRQAPGQGLEWIGYIYPYIGGSGYAQKFQGRVTMTADTSTSTVYMELSSLRSEDTAVYYCAREDKTARNAMDYWGQGTLVTVSS (SEQ ID NO:63) |
| humanized CHA.7.518 VH h518HH3 | QVQLVQSGAEVKKPGASVKISCKASGYTFTDYNINWVRQAPGQGLEWIGYIYPYIGGSGYAQKFQGRATLTADTSTSTAYMELSSLRSEDTAVYYCAREDKTARNAMDYWGQGTLVTVSS (SEQ ID NO:64) |
| humanized CHA.7.518 VH h518HH4 | QVQLVQSGAEVKKPGASVKISCKASGYTFTDYNINWVRQAPGQGLEWIGYIYPYIGGSGYAQKFQGRATLTADNSTSTAYMELSSLRSEDTAVYYCAREDKTARNAMDYWGQGTLVTVSS (SEQ ID NO:65) |
| humanized CHA.7.518 VL h518HL1 | DIQMTQSPSSLSASVGDRVTITCRVSENIYSNLAWYQQKPGKAPKLLIYEATNLAEGVPSRFSGSGSGT DFTLTISSLQPEDFATYYCQHFWGTPYTFGQGTKLEIK (SEQ ID NO:66) |
| humanized CHA.7.518 VL h518HL2 | DIQMTQSPSSLSASVGDRVTITCRVSENIYSNLAWYQQKPGKAPKLLIYEATNLAEGVPSRFSGSGSGT DYTLTISSLQPEDFATYYCQHFWGTPYTFGQGTKLEIK (SEQ ID NO:67) |
| humanized CHA.7.518 VL h518HL3 | DIQMTQSPSSLSASVGDRVTITCRVSENIYSNLAWYQQKPGKAPKLLVYEATNLAEGVPSRFSGSGSG TDYTLTISSLQPEDFGTYYCQHFWGTPYTFGQGTKLEIK (SEQ ID NO:68) |

Figure 12B

| What | Sequences |
|---|---|
| humanized CHA.7.538_1 VH h5381HH1 | QVQLVQSGAEVKKPGASVKVSCKASGYAFTNYLIEWVRQAPGQGLEWMGVINPGSGGIYYAQKFQGRVTMTRDTSTSTVYMELSSLRSEDTAVYYCARSETHDTWFAYWGQGTLVTVSS (SEQ ID NO:69) |
| humanized CHA.7.538_1 VH h5381HH2 | QVQLVQSGAEVKKPGASVKVSCKASGYAFTNYLIEWVRQAPGQGLEWIGVINPGSGGIYYAQKFQGRVTMTADTSTSTVYMELSSLRSEDTAVYYCARSETHDTWFAYWGQGTLVTVSS (SEQ ID NO:70) |
| humanized CHA.7.538_1 VH h5381HH3 | QVQLVQSGAEVKKPGASVKVSCKTSGYAFTNYLIEWVRQAPGQGLEWIGVINPGSGGIYYAQKFQGRVTLTADTSTSTAYMELSSLRSEDTAVYYCARSETHDTWFAYWGQGTLVTVSS (SEQ ID NO:71) |
| humanized CHA.7.538_1 VH h5381HH4 | QVQLVQSGAEVKKPGASVKVSCKTSGYAFTNYLIEWVRQAPGQGLEWIGVINPGSGGIYYAQKFQGRVTLTADKSTSTAYMELSSLRSEDTAVYYCARSETHDTWFAYWGQGTLVTVSS (SEQ ID NO:72) |
| humanized CHA.7.538_1/538_2 VL h538HL1 | DIQMTQSPSSLSASVGDRVTITCKASQSVRIAVAWYQQKPGKAPKLLIYLASTRHTGVPSRFSGSGSGTDFTLTISSLQPEDFATYYCLQHWNYPYTFGQGTKLEIK (SEQ ID NO:73) |
| humanized CHA.7.538_1/538_2 VL h538HL2 | DIQMTQSPSSLSASVGDRVTITCKASQSVRIAVAWFQQKPGKAPKALIYLASTRHTGVPSRFSGSGSGTDFTLTISSVQPEDFATYYCLQHWNYPYTFGQGTKLEIK (SEQ ID NO:74) |

Figure 12C

| What | Sequences |
|---|---|
| humanized CHA.7.538_2 VH h5382HH1 | QVQLVQSGAEVKKPGASVKVSCKASGYTFTNYWIGWVRQAPGQGLEWMGDIYPGGGYTNYAQKF QGRVTMTRDTSTSTVYMELSSLRSEDTAVYYCARPYYGSSYGFAFWGQGTLVTVSS<br><br>(SEQ ID NO:75) |
| humanized CHA.7.538_2 VH h5382HH2 | QVQLVQSGAEVKKPGASVKVSCKASGYTFTNYWIGWVRQAPGQGLEWIGDIYPGGGYTNYAQKFQ GRVTMTADTSTSTVYMELSSLRSEDTAVYYCASPYYGSSYGFAFWGQGTLVTVSS<br><br>(SEQ ID NO:76) |
| humanized CHA.7.538_2 VH h5382HH3 | QVQLVQSGAEVKKPGASVKMSCKASGYTFTNYWIGWVRQAPGQGLEWIGDIYPGGGYTNYAQKFQ GRATLTADTSTSTAYMELSSLRSEDTAVYYCASPYYGSSYGFAFWGQGTLVTVSS<br><br>(SEQ ID NO:77) |
| humanized CHA.7.538_1/538_2 VL h538HL1 | DIQMTQSPSSLSASVGDRVTITCKASQSVRIAVAWYQQKPGKAPKLLIYLASTRHTGVPSRFSGSGSGT DFTLTISSLQPEDFATYYCLQHWNYPYTFGQGTKLEIK<br><br>(SEQ ID NO:78) |
| humanized CHA.7.538_1/538_2 VL h538HL2 | DIQMTQSPSSLSASVGDRVTITCKASQSVRIAVAWFQQKPGKAPKALIYLASTRHTGVPSRFSGSGSGT DFTLTISSVQPEDFATYYCLQHWNYPYTFGQGTKLEIK<br><br>(SEQ ID NO:79) |

Figure 13 humanized CHA.7 VH-VL Pairs

Antibody CHA.7.518

| | VH | VL |
|---|---|---|
| ch518 | chimVH | chimVL |
| h518-1 | h518HH1 | h518HL1 (optional) |
| h518-2 | h518HH2 | h518HL2 |
| h518-3 | h518HH3 | h518HL2 |
| h518-4 | h518HH3 | h518HL3 |
| h518-5 | h518HH4 | h518HL3 |

Antibody CHA.7.538_1

| | VH | VL |
|---|---|---|
| ch538.1 | chimVH | chimVL |
| h538.1-1 | h538.1HH1 | h538.1HL1 (optional) |
| h538.1-2 | h538.1HH2 | h538.1HL2 |
| h538.1-3 | h538.1HH3 | h538.1HL2 |
| h538.1-4 | h538.1HH4 | h538.1HL2 |

Antibody CHA.7.538_2

| | VH | VL |
|---|---|---|
| ch538.2 | chimVH | chimVL |
| h538.2-1 | h538.2HH1 | h538.1HL1 (optional) |
| h538.2-2 | h538.2HH2 | h538.1HL2 |
| h538.2-3 | h538.2HH3 | h538.1HL2 |

FIG. 14

| Antibody (mIgG) | Human CD56 int. NK (gMFIr, 10ug/ml) | Human CD8+ T cells (gMFIr, 10ug/ml) | Expi cyno OE/par (gMFIr, 3.3ug/ml) | Cyno NK cells (gMFIr, 10ug/ml) | Cyno CD8+ T cells (gMFIr, 10ug/ml) |
|---|---|---|---|---|---|
| CHA.7.502 | 1.97 | 1.41 | 60.49 | Not tested | Not tested |
| CHA.7.503 | 3.15 | 1.96 | 106.3 | Not tested | Not tested |
| CHA.7.506 | Not tested | Not tested | 0.77 | Not tested | Not tested |
| CHA.7.508 | 3.6 | 4.09 | 41.49 | Not tested | Not tested |
| CHA.7.510 | 3.13 | 2.73 | 38.21 | Not tested | Not tested |
| CHA.7.512 | 1.30 | 1.15 | 8.96 | Not tested | Not tested |
| CHA.7.514 | 4.16 | 5.15 | 65.20 | Not tested | Not tested |
| CHA.7.516 | 4.22 | 4.09 | 60.05 | 1.76 | 2.09 |
| CHA.7.518 | 5.08 | 6.69 | 83.51 | 1.92 | 2.09 |
| CHA.7.520 | 1.13 | 1.04 | Not tested | Not tested | Not tested |
| CHA.7.522 | 2.06 | 1.90 | 27.24 | Not tested | Not tested |
| CHA.7.524 | 5.50 | 6.12 | 66.32 | 1.78 | 2.02 |
| CHA.7.525 | 1.98 | 1.76 | 0.85 | Not tested | Not tested |
| CHA.7.526 | 2.08 | 1.71 | 0.79 | Not tested | Not tested |
| CHA.7.527 | 1.16 | 0.99 | Not tested | Not tested | Not tested |
| CHA.7.528 | 3.08 | 3.63 | 12.2 | 1.21 | 1.18 |
| CHA.7.530 | 6.04 | 6.47 | 60.80 | 1.73 | 1.89 |
| CHA.7.534 | 2.60 | 1.96 | 46.27 | Not tested | Not tested |
| CHA.7.535 | 2.24 | 1.28 | 0.82 | Not tested | Not tested |
| CHA.7.537 | 3.90 | 3.41 | 1.55 | 1.18 | 1.19 |
| CHA.7.538 | 6.49 | 6.17 | 15.16 | 1.36 | 1.45 |
| CHA.7.543 | 4.48 | 4.33 | 0.83 | 1.35 | 1.39 |
| CHA.7.544 | 2.36 | 2.54 | 61.09 | Not tested | Not tested |
| CHA.7.545 | 2.54 | 2.82 | 0.91 | Not tested | Not tested |
| CHA.7.546 | 2.75 | 2.95 | 0.85 | Not tested | Not tested |
| CHA.7.547 | 2.21 | 1.13 | 26.65 | Not tested | Not tested |
| CHA.7.548 | 3.15 | 3.35 | 4.25 | 1.18 | 1.09 |
| CHA.7.549 | 3.05 | 1.42 | 1.00 | Not tested | Not tested |
| CHA.7.550 | 1.60 | 1.29 | 0.90 | Not tested | Not tested |

FIG. 15

| Antibody (mIgG) | $IC_{50}$ (nM) |
|---|---|
| CHA.7.502 | 39.90 |
| CHA.7.503 | No $IC_{50}$ |
| CHA.7.506 | 31.65 |
| CHA.7.508 | 37.88 |
| CHA.7.510 | 55.00 |
| CHA.7.512 | 839.6 |
| CHA.7.514 | 38.88 |
| CHA.7.516 | 33.11 |
| CHA.7.518 | 23.15 |
| CHA.7.520 | 619.3 |
| CHA.7.522 | 50.48 |
| CHA.7.524 | 30.20 |
| CHA.7.525 | 85.52 |
| CHA.7.526 | 58.88 |
| CHA.7.527 | No $IC_{50}$ |
| CHA.7.528 | 28.88 |
| CHA.7.530 | 34.56 |
| CHA.7.534 | 181.4 |
| CHA.7.535 | 821.1 |
| CHA.7.537 | 38.95 |
| CHA.7.538 | 51.87 |
| CHA.7.543 | No $IC_{50}$ |
| CHA.7.544 | No $IC_{50}$ |
| CHA.7.545 | 96.06 |
| CHA.7.546 | 92.05 |
| CHA.7.547 | 27.94 |
| CHA.7.548 | 18.98 |
| CHA.7.549 | 36.12 |
| CHA.7.550 | 58.34 |

FIG. 16

| Antibody (hIgG1) | Target Cell line | Fold change in cytotoxicity relative to control |
|---|---|---|
| CPA.7.002 | Reh | 2.9 |
|  | MOLM-13 | 1.9 |
| CPA.7.005 | Reh | 1.6 |
|  | MOLM-13 | 1.6 |
| CPA.7.021 | Reh | 1.9 |
|  | MOLM-13 | 0.7 |
| CPA.7.036 | Reh | 0.9 |
| CPA.7.037 | Reh | 1.1 |
| CPA.7.038 | Reh | 0.8 |
| CPA.7.041 | Reh | 0.7 |
| CPA.7.042 | Reh | 0.7 |
| CPA.7.050 | Reh | 1.6 |
| TIGIT | Reh | 1.1 |
|  | MOLM-13 | 1.1 |
| DNAM-1 | Reh | 1.2 |

FIG. 17

```
NP_076975.2-Homosapiens            TPEVWVQVRNEATELSSFTIRCGFLGSGSISLVTVSWGGPDGAGGTRLAVLHPERGIRQW
XP_005549281.1-Macacafascicularis  TPEVWVQVQNEATELSSFTIRCGFLGPGSISLVTVSWGGPDGAGGTRLAVLHPELGIRQW
XP_003732227.1-Callithrixjacchus   TPEVWVQVQNEATELSSFTIRCGFLGSGSISLVTVSWGGPDGAGGTRLAVLHPELGIRQW
XP_001103603.1-Macacamulatta       TPEVWVQVQNEATELSSFTIRCGFLGPGSISLVTVSWGGPDGAGGTRLAVLHPELGIRQW
                                   *******.*.*******..*****.*******************.******.*.***
                                         *   *  *

NP_076975.2-Homosapiens            APARQARWETQSSISLILERSGASSPCANTTFCCKFASFPEGSWEACGSLPPSSDPGLSA
XP_005549281.1-Macacafascicularis  APARQARWETQSSISLALERSGASSPRANTTFCCKFASFPEGSWESCGSLPPSSDPGLSA
XP_003732227.1-Callithrixjacchus   APAHQARWETQSSISLILEPGASSPSANTTFCCKFASFPEGSWEACGSLPPSSDPGLSA
XP_001103603.1-Macacamulatta       APARQARWETQSSISLALERSGASSPRANTTFCCKFASFPEGSWESCGSLPPSSDPGLSA
                                   ***.***********.**  **  *****.**************.*************
                                                  *

NP_076975.2-Homosapiens            PPTPAPILRAD
XP_005549281.1-Macacafascicularis  PPTPVPILRAD
XP_003732227.1-Callithrixjacchus   PIL-----RAD
XP_001103603.1-Macacamulatta       PPTPVPILRAD
                                    *    ***
```

SEQ ID NOS:80-83, respectively in order of appearance

FIG. 18A     FIG. 18B     FIG. 18C
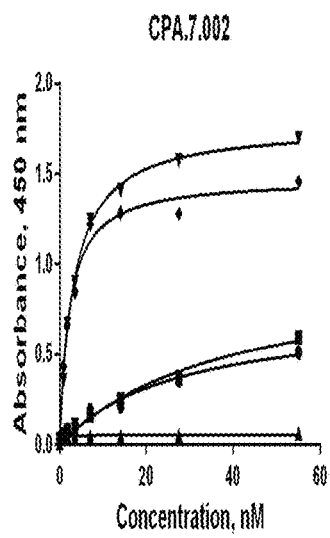
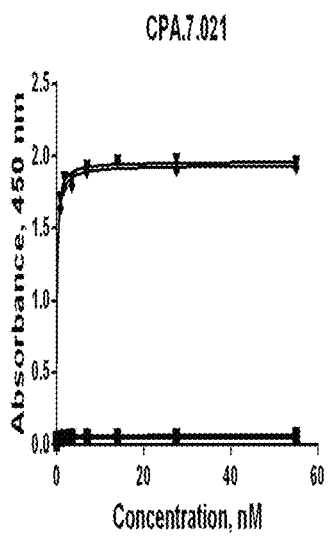
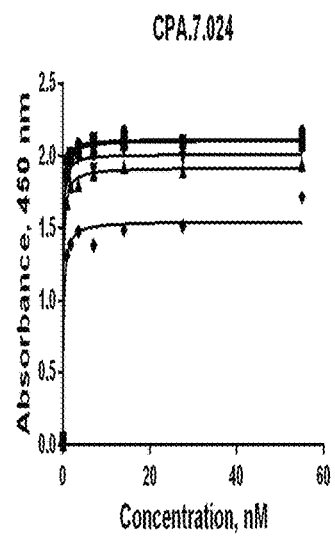
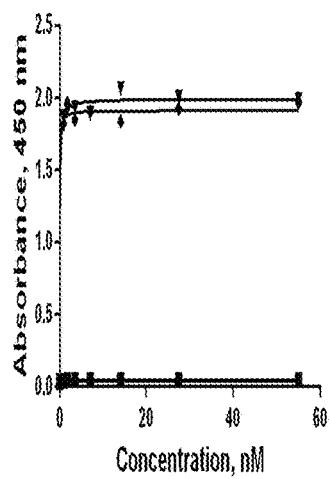
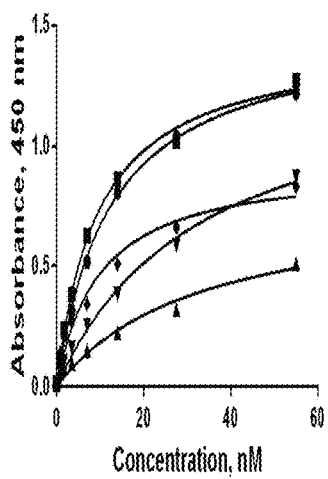
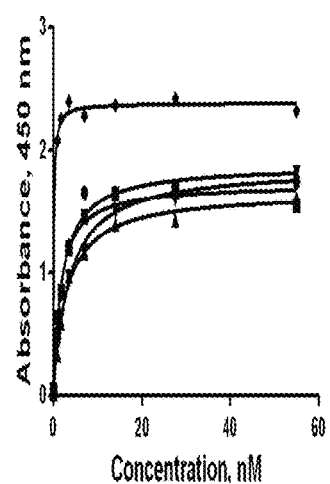
FIG. 18D     FIG. 18E     FIG. 18F

FIG. 19

| mAb | Cyno cross-reactivity | Epitope bin | Epitope group |
|---|---|---|---|
| CPA.7.002 | + | 1 | 2 |
| CPA.7.021 | - | 1 | 1 |
| CPA.7.024 | +++ | 1 | 3 |
| CPA.7.028 | - | 1 | 1 |
| CPA.7.041 | ++ | 1 | 2 |
| CPA.7.050 | +++ | 4 | 3 |

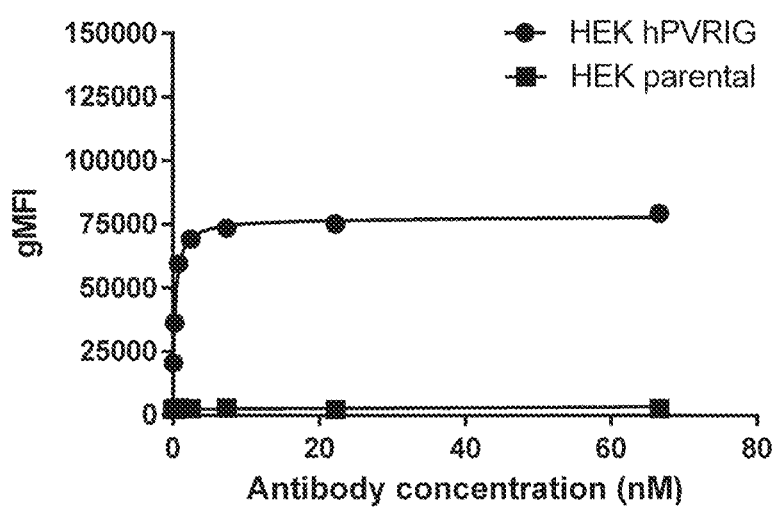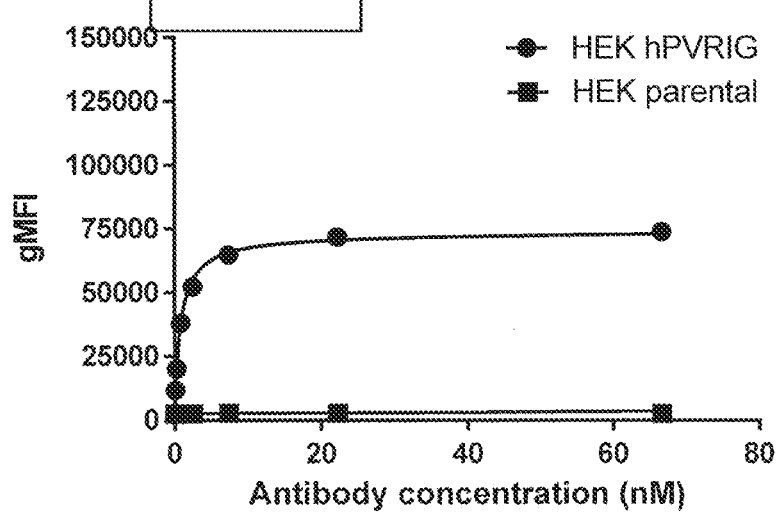

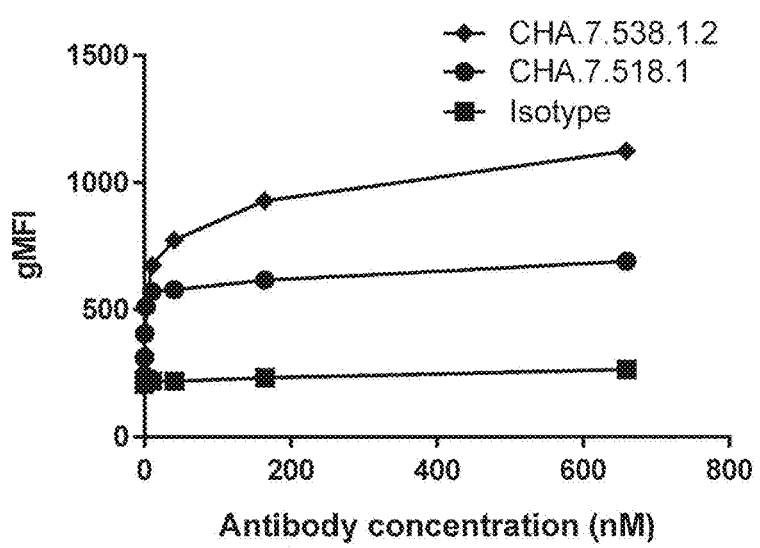

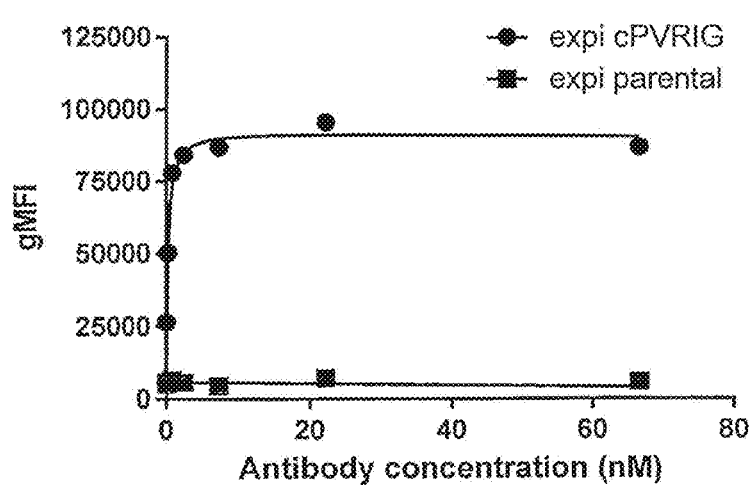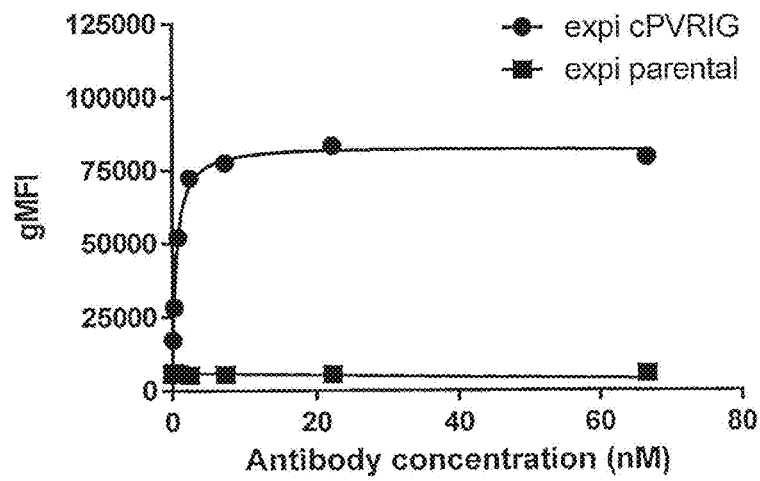

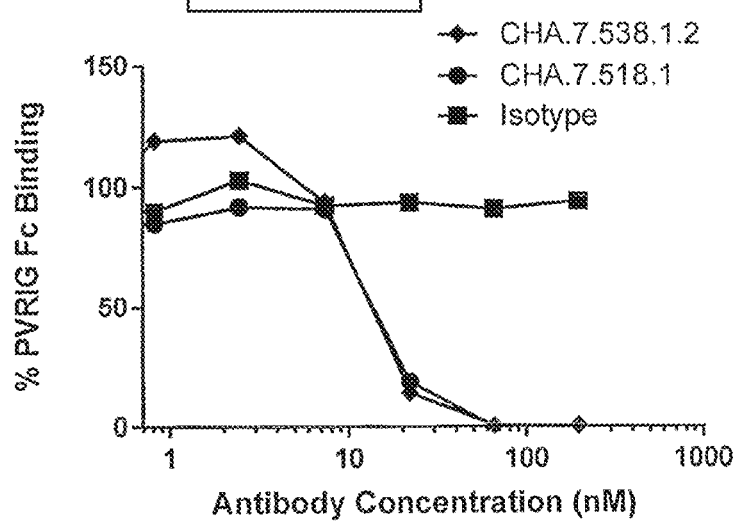
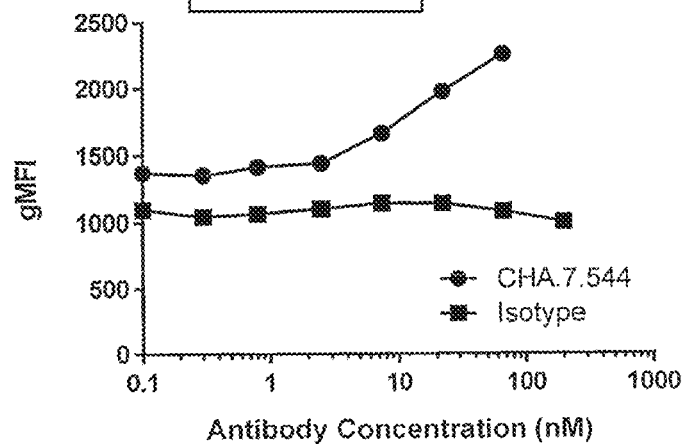

FIG. 26

|  | CHA.7.518.1 (Alexa 647) | CHA.7.538.1.2 (Alexa 647) |
|---|---|---|
| Isotype (unconjugated) | 100 | 100 |
| CHA.7.518.1 (unconjugated) | 14 | 32 |
| CHA.7.538.1.2 (unconjugated) | 7 | 7 |

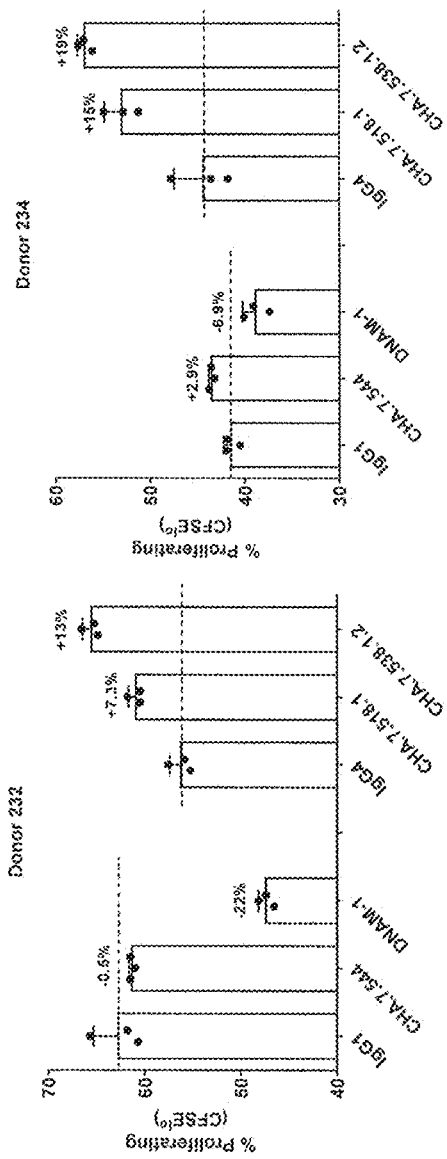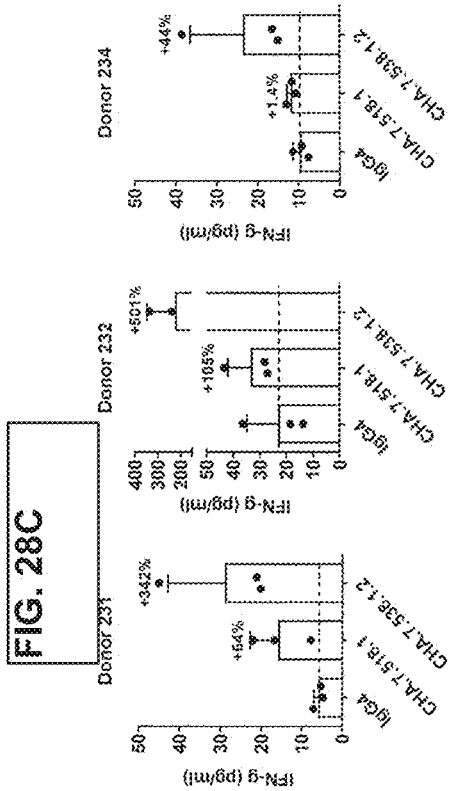
FIG. 28A  FIG. 28B  FIG. 28C

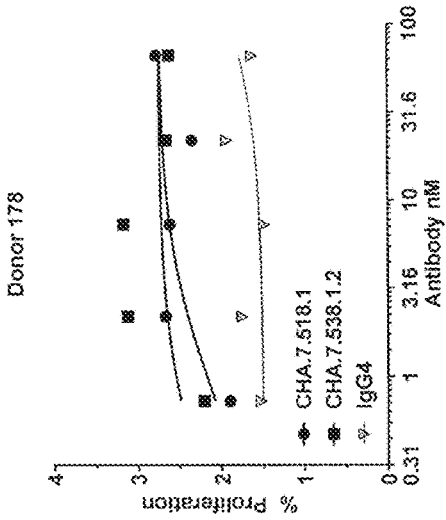
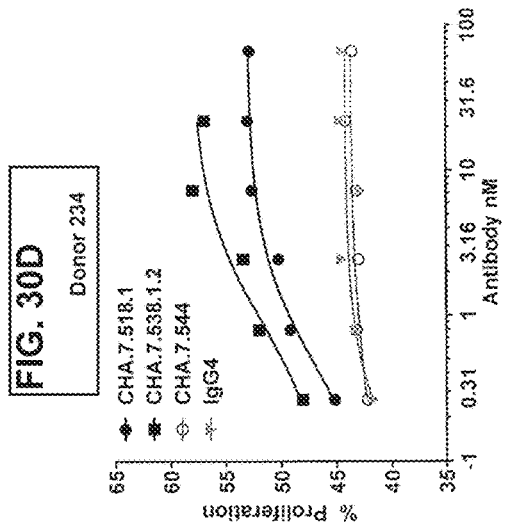
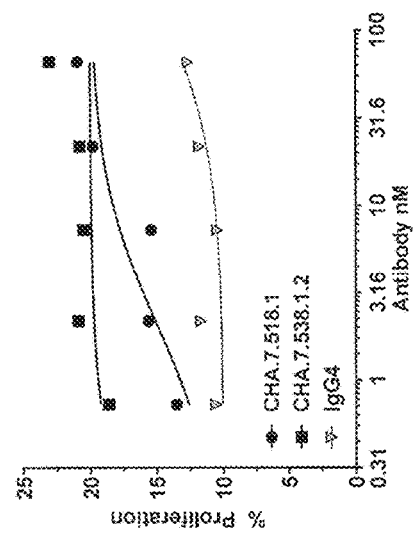
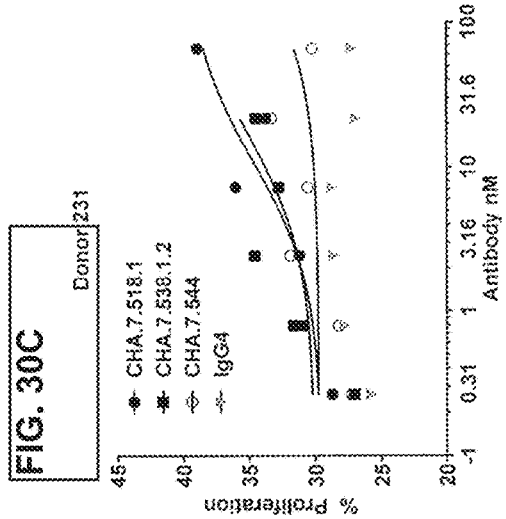

FIG. 31A
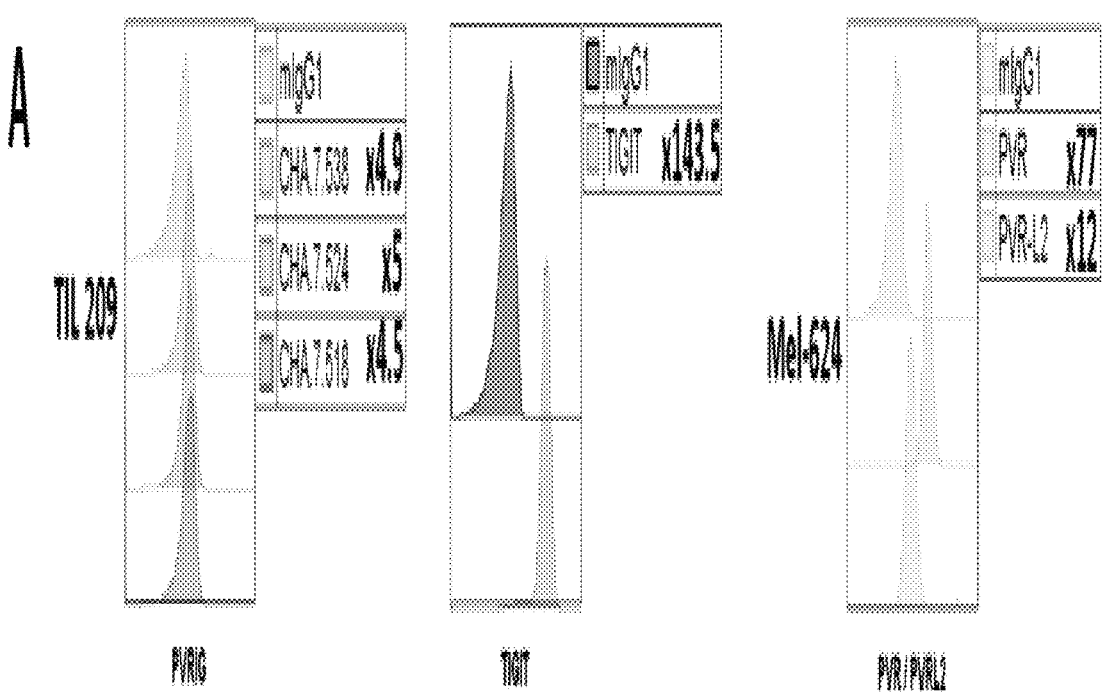
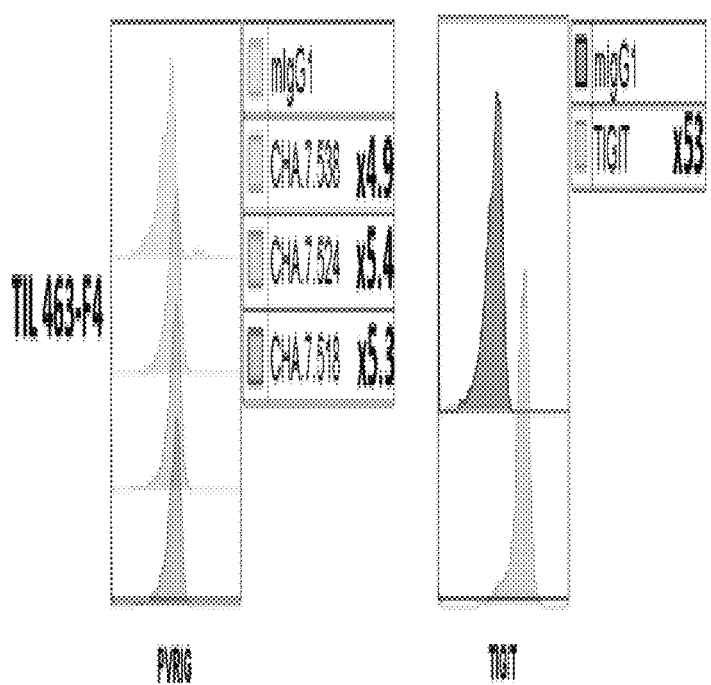

mono 518 TIL 209 mono 538 TIL 209 combo 518 TIL 209 combo 538 TIL 209 mono 518 TIL 463 F4 mono 538 TIL 463 F4 combo 518 TIL 463 F4 combo 538 TIL 463 F4

FIG. 39A

| peptide 0.5ug/ml | | TIGIT | 544 | c538 | c518 | TIGIT+c518 |
|---|---|---|---|---|---|---|
| TIL-209 | IFNγ | 111% | 11% | 29% | 29% | 171% |
| | TNFα | 181% | 17% | 20% | 23% | 216% |
| TIL-F4 | IFNγ | 32% | <5% | <5% | 11% | 47% |
| | TNFα | 63% | <5% | <5% | 21% | 83% |
| TIL-F5 | IFNγ | 37% | 15% | 39% | 56% | 86% |
| | TNFα | 44% | 5% | <5% | 9% | 54% |

FIG. 39B

| peptide 0.1ug/ml | | 544 | c538 | c518 |
|---|---|---|---|---|
| TIL-209 | IFNγ | 12% | 48% | 39% |
| | TNFα | 20% | 47% | 38% |
| TIL-F4 | IFNγ | 8% | 13% | 9% |
| | TNFα | 7% | 31% | 15% |
| TIL-F5 | IFNγ | 3% | 31% | 21% |
| | TNFα | 0% | 10% | 14% |

FIG. 39C

| peptide 0.1ug/ml | | 544 | c538 | c518 | TIGIT | c538+ TIGIT | c518+ TIGIT |
|---|---|---|---|---|---|---|---|
| TIL-209 | IFNγ | 2% | 16% | 19% | 97% | 154% | 157% |
| | TNFα | 7% | 28% | 27% | 150% | 190% | 180% |
| TIL-F4 | IFNγ | 2% | 12% | 7% | 26% | 56% | 51% |
| | TNFα | 15% | 31% | 18% | 39% | 55% | 60% |
| TIL-F5 | IFNγ | 8% | 4% | 10% | 24% | 61% | 43% |
| | TNFα | 11% | 16% | 20% | 35% | 56% | 59% |
| MART-1 | IFNγ | 50% | 53% | 81% | 39% | 87% | 81% |

Fig. 40A
Fig. 40B
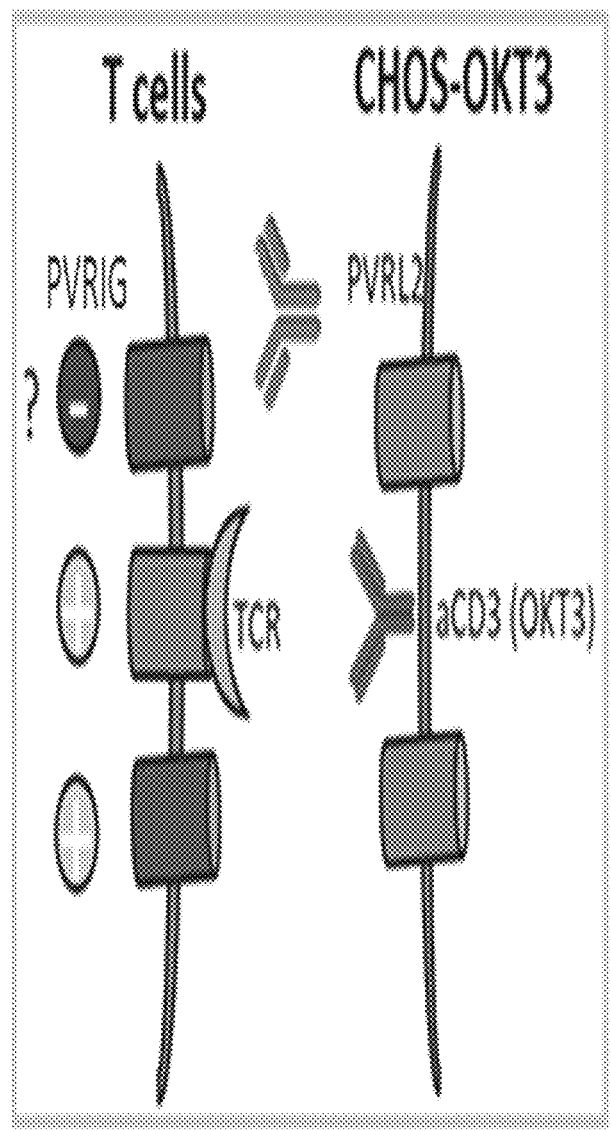
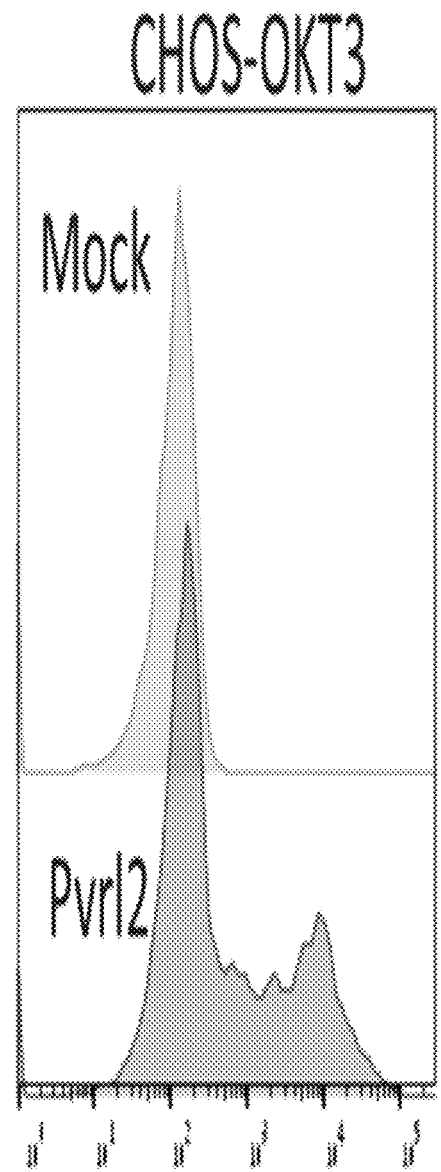

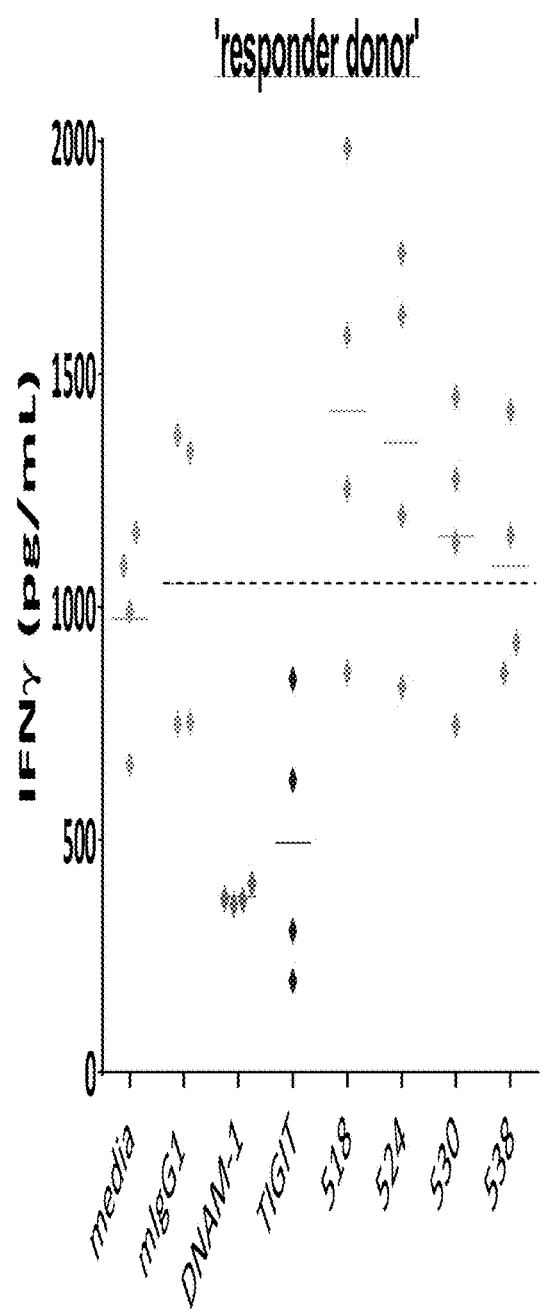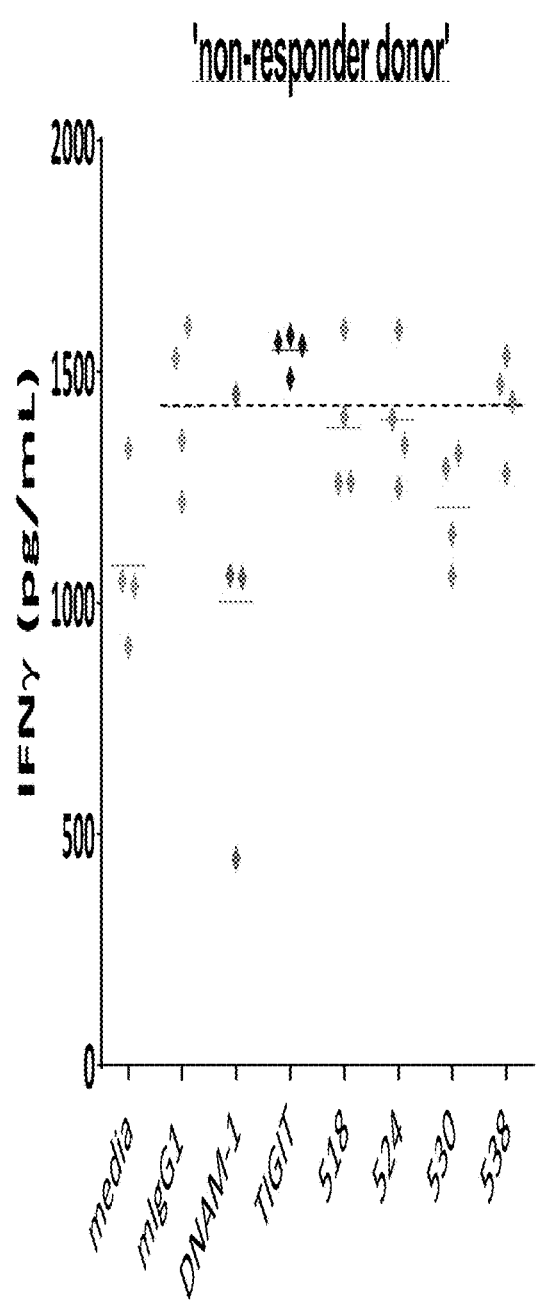

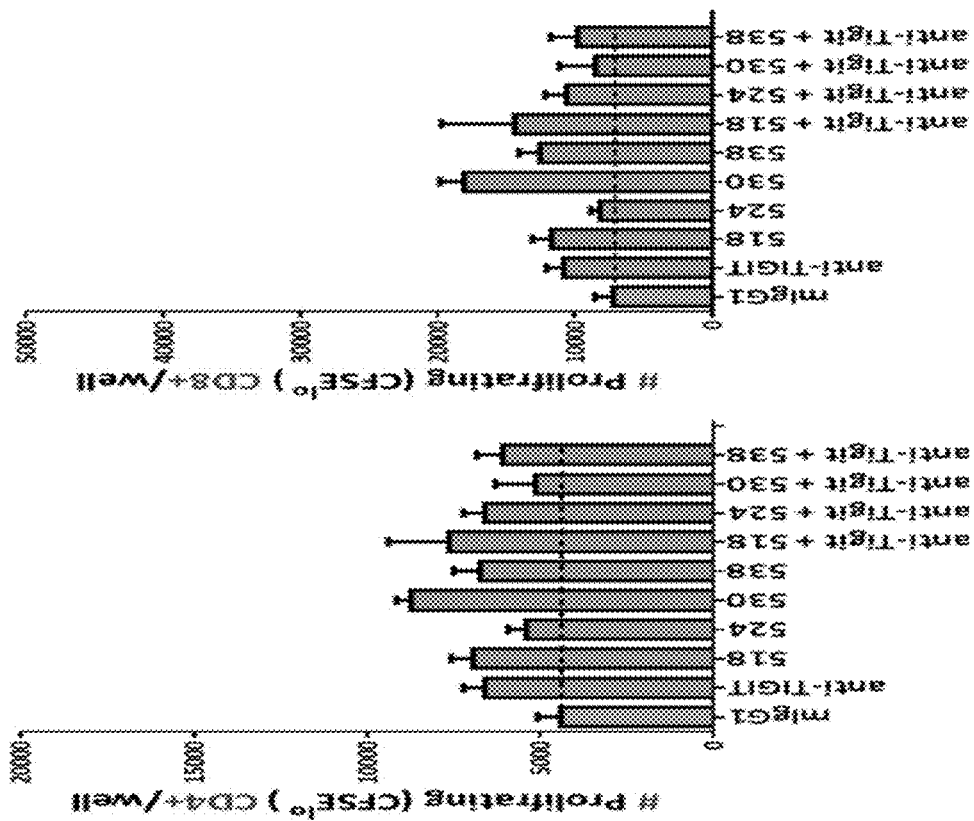
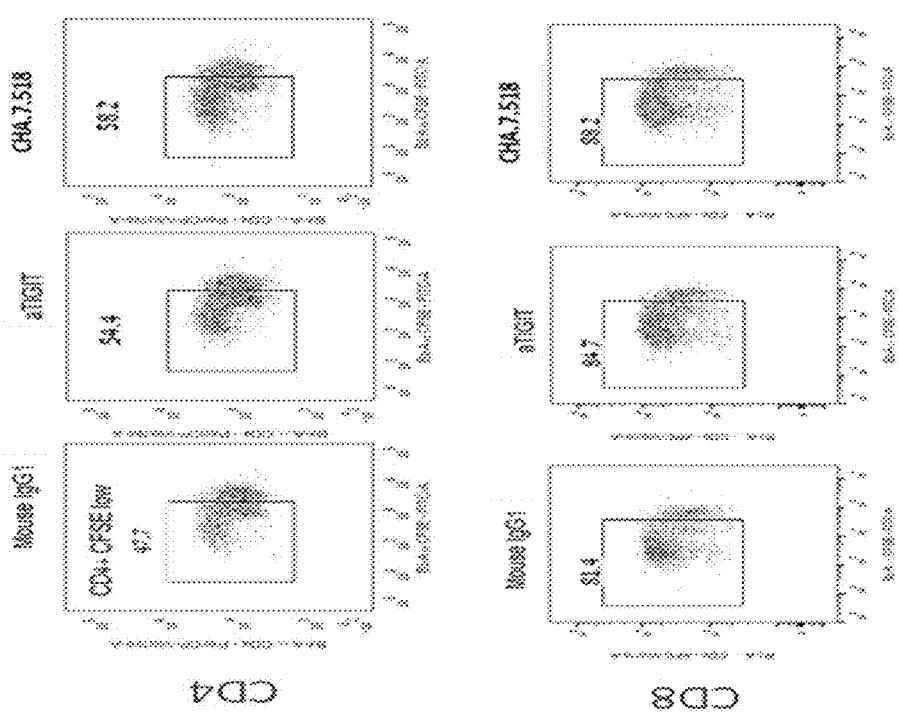
FIG. 42A
FIG. 42B

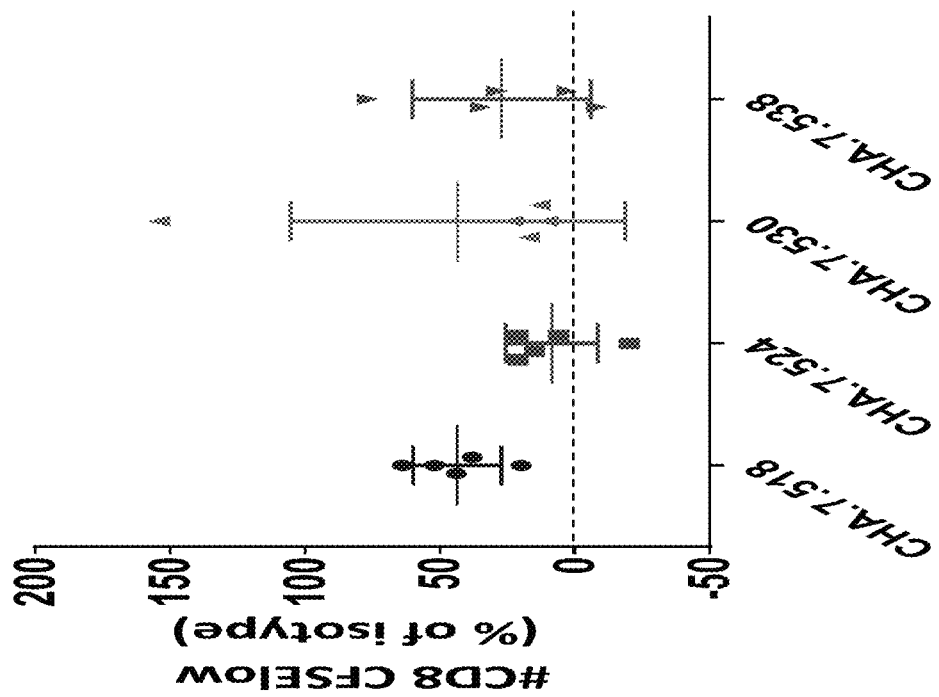
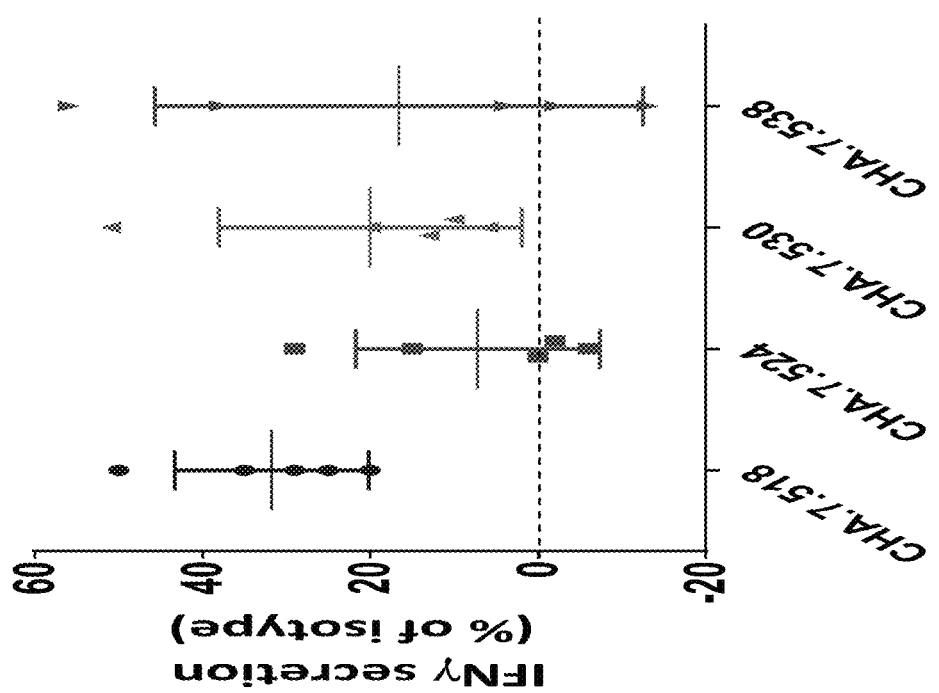

FIG. 44

| % of effect (vs. isotype) | exp # | Donor | IFNg | CD4+ total no. CFSE low | CD8+ total no. CFSE low |
|---|---|---|---|---|---|
| CHA.7.518 | 410-IB-003 | 3 | 25% | 24% | 52% |
| | 410-IB-003 | 72 | 29% | 58% | 64% |
| | 400-ES-002 | 226 | 50% | 16% | 38% |
| | 400-ES-002 | 345 | 20% | -26% | 20% |
| | 400-ES-002 | ES_001 | 35% | 39% | 44% |
| | 400-ES-003 | ES_002 | -3% | -22% | -17% |
| | 400-ES-003 | ES_004 | -20% | -14% | -15% |
| | 400-ES-003 | ES_005 | 1% | 5% | 1% |
| | 400-ES-003 | ES_006 | -11% | 4% | 12% |
| | 400-ES-003 | ES_007 | 4% | 6% | 15% |
| CHA.7.524 | 410-IB-003 | 3 | -2% | -9% | -20% |
| | 410-IB-003 | 72 | 0% | 23% | 15% |
| | 400-ES-002 | 226 | -6% | 0% | 6% |
| | 400-ES-002 | 345 | 15% | -21% | 21% |
| | 400-ES-002 | ES_001 | 29% | 25% | 21% |
| | 400-ES-003 | ES_002 | -2% | -10% | -14% |
| | 400-ES-003 | ES_004 | -18% | -8% | -7% |
| | 400-ES-003 | ES_005 | 12% | 10% | 12% |
| | 400-ES-003 | ES_006 | 2% | 8% | -10% |
| | 400-ES-003 | ES_007 | -4% | -4% | 2% |
| CHA.7.530 | 410-IB-003 | 3 | 20% | 16% | 10% |
| | 410-IB-003 | 72 | 51% | 98% | 154% |
| | 400-ES-002 | 226 | 13% | 3% | 13% |
| | 400-ES-002 | 345 | 6% | -25% | 23% |
| | 400-ES-002 | ES_001 | 10% | 20% | 17% |
| | 400-ES-003 | ES_002 | -15% | -23% | -29% |
| | 400-ES-003 | ES_004 | -20% | -7% | -10% |
| | 400-ES-003 | ES_005 | 11% | 5% | 13% |
| | 400-ES-003 | ES_006 | -20% | 5% | 17% |
| | 400-ES-003 | ES_007 | 0% | 0% | 11% |
| CHA.7.538 | 410-IB-003 | 3 | -13% | 1% | -8% |
| | 410-IB-003 | 72 | 38% | 53% | 77% |
| | 400-ES-002 | 226 | 56% | 24% | 29% |
| | 400-ES-002 | 345 | -2% | -22% | 35% |
| | 400-ES-002 | ES_001 | 4% | 0% | 3% |
| | 400-ES-003 | ES_002 | 0% | 1% | 1% |
| | 400-ES-003 | ES_004 | -21% | -9% | -5% |
| | 400-ES-003 | ES_005 | 18% | -1% | 0% |
| | 400-ES-003 | ES_006 | -21% | 6% | 13% |
| | 400-ES-003 | ES_007 | -4% | 11% | 20% |

FIG. 45A
| Cells | antibody | Kd | gMFI |
|---|---|---|---|
| HEK hPVRIG | CPA.7.021 IgG4 | 2.939 | 18.17 |
| HEK hPVRIG | CHA7.518 M1 | 0.36 | 42.24 |
| Jurkat | CPA.7.021 IgG4 | 3.18 | 10.08 |
| Jurkat | CHA7.518 M1 | 0.24 | 6.58 |
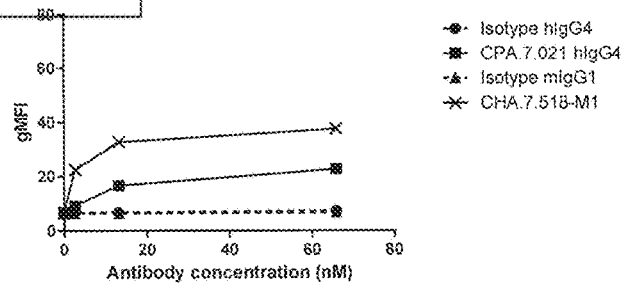
FIG. 45B
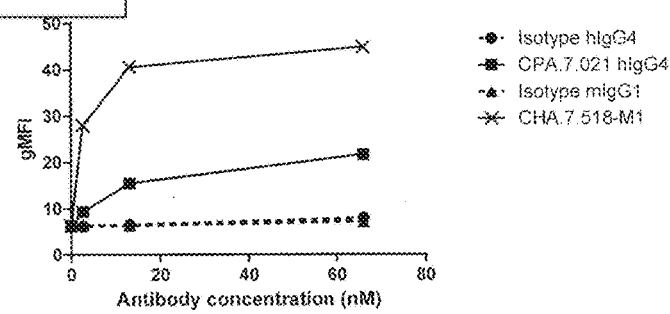
FIG. 45C

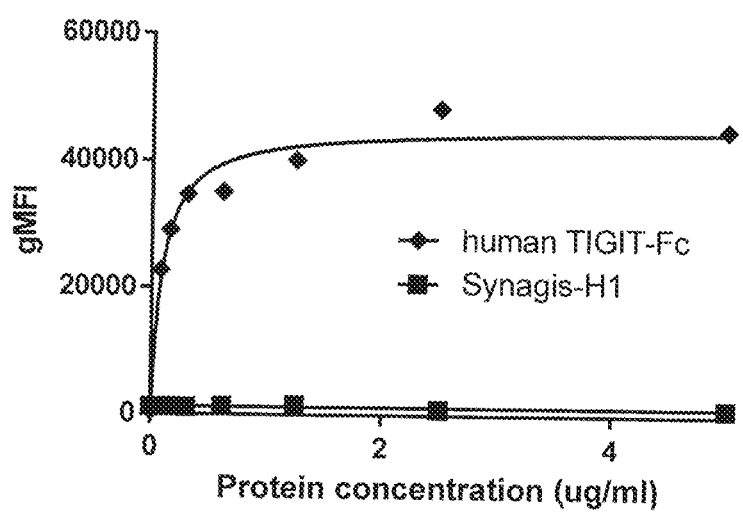
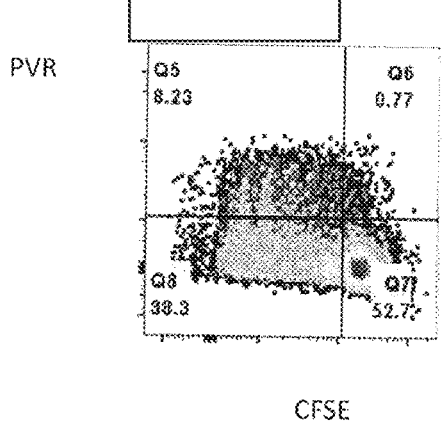

A) FIG. 49A

AB-407 (BOJ-5G4-F4)

Heavy chain: Amino acid sequence

MEWNWVFLFLLSVTAGVHSQVQLQQSGAELAKPGSSVMISCKASGYTFTN
YAVHWIKQTTGQALEWTGYIAPGSGVTKYNEKFKGKATLTVDKSSTTAYMQLSSLTPVDTAVYYCASGTTRFAYWGQ
GTLVTVSSAQTTAPSVYPLAPGCGDTTSSTVTLGCLVKG  (SEQ ID NO:84)

B) FIG. 49B

AB-407 (BOJ-5G4-F4)

Heavy chain: DNA sequence

ATGGAATGGAACTGGGTCTTTCTCTTCCTCCTGTCAGTAACTGCAGGAGTCCACTCCCAGGTCCAGC
TGCAGCAGTCTGGAGCTGAGCTGGCAAAGCCTGGCTCTTCAGTGATGATTTCCTGCAAGGCTTCTGG
TTACACCTTTACCAACTATGCTGTGCACTGGATAAAGCAGACGACTGGACAGGCCCTTGAGTGGACT
GGATATATTGCTCCTGGAAGTGGAGTTACTAAATACAATGAGAAGTTCAAGGGCAAGGCCACATTGA
CTGTAGACAAATCCTCAACCACAGCCTACATGCAACTCAGCAGCCTGACACCTGTGGACACTGCGGT
CTATTACTGTGCAAGCGGAACTACGAGGTTTGCTTATTGGGGCCAAGGCACTCTGGTCACTGTCTCT
TCA GCCCAAACAACAGCCCCATCTGTCTATCCACTGGCTCCTGGATGTGGTGATACAACCAGC
TCCACGGTGACTCTGGGATGCCTGGTCAAGGGC  (SEQ ID NO:85)

C) FIG. 49C

AB-407 (BOJ-5G4-F4)

Light chain: Amino acid sequence

METDTLLLWVLLLWVPGSTGDIVLTQSPALAVSLGQRATISCRASQSVSLSSYNLMQWYQQKPGQEP
KLLIYDASNLPSGIPARFSGSGSGTDFTLTIDPVQADDIATYYCQQSKDDPLTFGSGTKLEIK  (SEQ ID NO:86)

D) FIG. 49D

AB-407 (BOJ-5G4-F4)

Light chain: DNA sequence

ATGGAGACAGACACACTCCTGCTATGGGTGCTGCTGCTCTGGGTTCCAGGCTCCACTGGTGACATTG
TGCTGACCCAGTCTCCTGCTTTGGCTGTGTCTCTAGGGCAGAGGGCCACAATCTCCTGTAGAGCCAG
CCAAAGTGTCAGTTTATCCAGCTATAATCTCATGCAGTGGTACCAACAGAAACCAGGACAGGAACCC
AAAATCCTCATCTATGATGCATCCAACCTACCATCTGGGATCCCTGCCAGGTTCAGTGGCAGTGGGT
CTGGGACAGACTTCACCCTCACCATTGATCCTGTGCAGGCTGATGATATTGCAACCTATTACTGTCA
GCAGAGTAAGGATGACCCGCTCACGTTCGGTTCTGGGACCAAGCTGGAGATCAAA  (SEQ ID NO:87)

FIG. 50A

Human IgG1 constant region   (SEQ ID NO:88)

ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPELLGGPSVFLFPPKPKDTLMI
SRTPEVTCVVVDVSHEDPEVKFNWYVDGVEVHNAKTKPREEQYNSTYRVVSVLTVLHQDWLNGKEYKC
KVSNKALPAPIEKTISKAKGQPREPQVYTLPPSREEMTKNQVSLTCLVKGFYPSDIAVEWESNGQPEN
NYKTTPPVLDSDGSFFLYSKLTVDKSRWQQGNVFSCSVMHEALHNHYTQKSLSLSPGK

Human IgG1 D265A constant region   (SEQ ID NO:89)

ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPELLGGPSVFLFPPKPKDTLMI
SRTPEVTCVVV[A]VSHEDPEVKFNWYVDGVEVHNAKTKPREEQYNSTYRVVSVLTVLHQDWLNGKEYKC
KVSNKALPAPIEKTISKAKGQPREPQVYTLPPSREEMTKNQVSLTCLVKGFYPSDIAVEWESNGQPEN
NYKTTPPVLDSDGSFFLYSKLTVDKSRWQQGNVFSCSVMHEALHNHYTQKSLSLSPGK

Human IgG1 N297A constant region   (SEQ ID NO:90)

ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPELLGGPSVFLFPPKPKDTLMI
SRTPEVTCVVVDVSHEDPEVKFNWYVDGVEVHNAKTKPREEQY[A]STYRVVSVLTVLHQDWLNGKEYKC
KVSNKALPAPIEKTISKAKGQPREPQVYTLPPSREEMTKNQVSLTCLVKGFYPSDIAVEWESNGQPEN
NYKTTPPVLDSDGSFFLYSKLTVDKSRWQQGNVFSCSVMHEALHNHYTQKSLSLSPGK

Human IgG2 constant region   (SEQ ID NO:91)

ASTKGPSVFPLAPCSRSTSESTAALGCLVKDYFPEPVTVSWNSGALTSGVHTFPAVLQSSGLYSLSSV
VTVPSSNFGTQTYTCNVDHKPSNTKVDKTVERKCCVECPPCPAPPVAGPSVFLFPPKPKDTLMISRTP
EVTCVVVDVSHEDPEVQFNWYVDGVEVHNAKTKPREEQFNSTFRVVSVLTVVHQDWLNGKEYKCKVSN
KGLPAPIEKTISKTKGQPREPQVYTLPPSREEMTKNQVSLTCLVKGFYPSDIAVEWESNGQPENNYKT
TPPMLDSDGSFFLYSKLTVDKSRWQQGNVFSCSVMHEALHNHYTQKSLSLSPGK

Human IgG3 constant region   (SEQ ID NO:92)

ASTKGPSVFPLAPCSRSTSGGTAALGCLVKDYFPEPVTVSWNSGALTSGVHTFPAVLQSSGLYSLSSV
VTVPSSSLGTQTYTCNVNHKPSNTKVDKRVELKTPLGDTTHTCPRCPEPKSCDTPPPCPRCPEPKSCD
TPPPCPRCPEPKSCDTPPPCPRCPAPELLGGPSVFLFPPKPKDTLMISRTPEVTCVVVDVSHEDPEVQ
FKWYVDGVEVHNAKTKPREEQYNSTFRVVSVLTVLHQDWLNGKEYKCKVSNKALPAPIEKTISKTKGQ
PREPQVYTLPPSREEMTKNQVSLTCLVKGFYPSDIAVEWESSGQPENNYNTTPPMLDSDGSFFLYSKL
TVDKSRWQQGNIFSCSVMHEALHNRFTQKSLSLSPGK

FIG. 50B

Human IgG4 constant region (Wild Type) (SEQ ID NO:93)

ASTKGPSVFPLAPCSRSTSESTAALGCLVKDYFPEPVTVSWNSGALTSGVHTFPAVLQSSGLYSLSSV
VTVPSSSLGTKTYTCNVDHKPSNTKVDKRVESKYGPPCPSCPAPEFLGGPSVFLFPPKPKDTLMISRT
PEVTCVVVDVSQEDPEVQFNWYVDGVEVHNAKTKPREEQFNSTYRVVSVLTVLHQDWLNGKEYKCKVS
NKGLPSSIEKTISKAKGQPREPQVYTLPPSQEEMTKNQVSLTCLVKGFYPSDIAVEWESNGQPENNYK
TTPPVLDSDGSFFLYSRLTVDKSRWQEGNVFSCSVMHEALHNHYTQKSLSLSPGK

Human IgG4 constant region (S241P hinge mutant) (SEQ ID NO:94)

ASTKGPSVFPLAPCSRSTSESTAALGCLVKDYFPEPVTVSWNSGALTSGVHTFPAVLQSSGLYSLSSV
VTVPSSSLGTKTYTCNVDHKPSNTKVDKRVESKYGPPCPPCPAPEFLGGPSVFLFPPKPKDTLMISRT
PEVTCVVVDVSQEDPEVQFNWYVDGVEVHNAKTKPREEQFNSTYRVVSVLTVLHQDWLNGKEYKCKVS
NKGLPSSIEKTISKAKGQPREPQVYTLPPSQEEMTKNQVSLTCLVKGFYPSDIAVEWESNGQPENNYK
TTPPVLDSDGSFFLYSRLTVDKSRWQEGNVFSCSVMHEALHNHYTQKSLSLSPGK

Human kappa light chain (SEQ ID NO:95)

RTVAAPSVFIFPPSDEQLKSGTASVVCLLNNFYPREAKVQWKVDNALQSGNSQESVTEQDSKDSTYSL
SSTLTLSKADYEKHKVYACEVTHQGLSSPVTKSFNRGEC

Human lambda light chain (SEQ ID NO:96)

GQPKAAPSVTLFPPSSEELQANKATLVCLISDFYPGAVTVAWKADSSPVKAGVETTTPSKQSNNKYAA
SSYLSLTPEQWKSHRSYSCQVTHEGSTVEKTVAPTECS

Figure 51

Human TIGIT ECD  (SEQ ID NO:97)

MMTGTIETTGNISAEKGGSIILQCHLSSTTAQVTQVNWEQQDQLLAICNADLGWHISPSFKDRVAPGP
GLGLTLQSLTVNDTGEYFCIYHTYPDGTYTGRIFLEVLESSVAEHGARFQIP

Cyno macaque TIGIT ECD  (SEQ ID NO:98)

MMTGTIETTGNISAKKGGSVILQCHLSSTMAQVTQVNWEQHDHSLLAIRNAELGWHIYPAFKDRVAPG
PGLGLTLQSLTMNDTGEYFCTYHTYPDGTYRGRIFLEVLESSVAEHSARFQIP

Human PVR ECD  (SEQ ID NO:99)

DVVVQAPTQVPGFLGDSVTLPCYLQVPNMEVTHVSQLTWARHGESGSMAVFHQTQGPSYSESKRLEFV
AARLGAELRNASLRMFGLRVEDEGNYTCLFVTFPQGSRSVDIWLRVLAKPQNTAEVQKVQLTGEPVPM
ARCVSTGGRPPAQITWHSDLGGMPNTSQVPGFLSGTVTVTSLWILVPSSQVDGKNVTCKVEHESFEKP
QLLTVNLTVYYPPEVSISGYDNNWYLGQNEATLTCDARSNPEPTGYNWSTTMGPLPPFAVAQGAQLLI
RPVDKPINTTLICNVTNALGARQAELTVQVKEGPPSEHSGMSRN

Figure 52

| Campaign | Antibody ID | MFIr (OE/Par) hTIGIT | MFIr (OE/Par) cTIGIT |
|---|---|---|---|
| 1 | CPA.9.002 | 98 | ND |
| 1 | CPA.9.009 | 8.7 | ND |
| 1 | CPA.9.011 | 12 | ND |
| 1 | CPA.9.012 | 12 | ND |
| 1 | CPA.9.013 | 25 | ND |
| 1 | CPA.9.014 | 110 | ND |
| 1 | CPA.9.015 | 10 | ND |
| 1 | CPA.9.018 | 16 | ND |
| 1 | CPA.9.053 | 4.4 | ND |
| 2 | CPA.9.057 | 30 | ND |
| 2 | CPA.9.059 | 11 | ND |
| 2 | CPA.9.064 | 5 | ND |
| 2 | CPA.9.069 | 5 | ND |
| 2 | CPA.9.071 | 5.7 | ND |
| 2 | CPA.9.077 | 19 | ND |
| 2 | CPA.9.081 | 7.6 | ND |
| 3 | CPA.9.027 | 110 | ND |
| 3 | CPA.9.049 | 94 | ND |
| 4 | CPA.9.083 | 170 | 97 |
| 4 | CPA.9.086 | 36 | 34 |
| 4 | CPA.9.089 | 110 | 52 |
| 4 | CPA.9.093 | 80 | 60 |
| 4 | CPA.9.101 | 130 | 22 |
| 4 | CPA.9.103 | 95 | 30 |

Figure 53A: CPA.9.086

| What | sequence | SEQ ID NO: |
|---|---|---|
| Variable heavy (vh) domain | EVQLVETGGGLIQPGRSLRLSCAASGFTFSSYAMHWVRQAPGKGLEWVAVISYAGEVKYYADSVKGRFTISRDNSKNTLYLQMNSLRAEDTAVYYCARDPLPLHYYGMDVWGQGTTVTVSS | 160 |
| vhCDR1 | GFTFSSYA | 161 |
| vhCDR2 | ISYAGEVK | 162 |
| vhCDR3 | ARDPLPLHYYGMDV | 163 |
| Full length HC (IgG4(S241P)) | EVQLVETGGGLIQPGRSLRLSCAASGFTFSSYAMHWVRQAPGKGLEWVAVISYAGEVKYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 164 |
| Variable light (vl) domain | QSALTQPRSASGNPGQRVTISCSGSSSNMGRRPGVNWYQQIPGTAPKLLIYSQNQRPSGVPDRFSGSQSGTSASLTISGLQSEDEAEYFCAVWDDIGRVLQLGGGTQLAVLG | 165 |
| vlCDR1 | SSNMGRRP | 166 |
| vlCDR2 | SQN | 167 |
| vlCDR3 | AVWDDIGRVLQ | 168 |
| Full length light chain | QSALTQPRSASGNPGQRVTISCSGSSSNMGRRPGVNWYQQIPGTAPKLLIYSQNQRPSGVPDRFSGSQSGTSASLTISGLQSEDEAEYFCAVWDDIGRVLQLGGGTQLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 169 |

Figure 53B: CPA.9.083

| What | sequence | SEQ ID NO: |
|---|---|---|
| Variable heavy (vh) domain | EVQLVETGGGLIQPGRSLRLSCAASGFTFSSYAMHWVRQAPGKGLEWVAVISYDGTPVYYADSVKGRFTISRDNSKNTLYLQMNSLRAEDTAVYYCARDPLPLHYYGMDVWGQGTTVTSS | 150 |
| vhCDR1 | GFTFSSYA | 151 |
| vhCDR2 | ISYDGTPV | 152 |
| vhCDR3 | ARDPLPLHYYGMDV | 153 |
| Full length HC (IgG4(S241P)) | EVQLVETGGGLIQPGRSLRLSCAASGFTFSSYAMHWVRQAPGKGLEWVAVISYDGTPVYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 154 |
| Variable light (vl) domain | QSALTQPRSASGNPGQRVTISCSGSSSNMGRRPVNWYQQIPGTAPKLLIYSQNQRPSGVPDRFSGSQSGTSASLTISGLQSEDEAEYFCAVWDGDRRSLQLGGGTQLAVLG | 155 |
| vlCDR1 | SSNMGRRP | 156 |
| vlCDR2 | SQN | 157 |
| vlCDR3 | AVWDGDRRSLQ | 158 |
| Full length light chain | QSALTQPRSASGNPGQRVTISCSGSSSNMGRRPVNWYQQIPGTAPKLLIYSQNQRPSGVPDRFSGSQSGTSASLTISGLQSEDEAEYFCAVWDGDRRSLQLGGGTQLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 159 |

Figure 53C: CHA.9.547.13

| What | Sequence | SEQ ID NO: |
|---|---|---|
| Variable heavy (vh) domain | EVQLVESGGGLVQPGGSLRLSCAASGFTFSSYIMSWVRQAPGKGLEWVATISGGGTNTYYADSVKGRFTISRDNSKN TLYLQMNSLRAEDTAVYYCAKWLLSYYAMDYWGQGTLVTVSS | 560 |
| vhCDR1 | GFTFSSYIMS | 561 |
| vhCDR2 | TISGGGTNTY | 562 |
| vhCDR3 | WLLSYYAMDY | 563 |
| Full length HC | EVQLVESGGGLVQPGGSLRLSCAASGFTFSSYIMSWVRQAPGKGLEWVATISGGGTNTYYADSVKGRFTISRDNSKN TLYLQMNSLRAEDTAVYYCAKWLLSYYAMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 564 |
| Variable light (vl) domain | DIQMTQSPSSLSASVGDRITITCRASQNINVWLSWYQQKPGKAPKLLIYKASKSHTGVPSRFSGSGSGTDFTLTISS LQPEDFATYYCQQGQSYPYTFGQGTKLEIK | 565 |
| vlCDR1 | RASQNINVWLS | 566 |
| vlCDR2 | KASKSHT | 567 |
| vlCDR3 | QQGQSYPYT | 568 |
| Full length light chain | DIQMTQSPSSLSASVGDRITITCRASQNINVWLSWYQQKPGKAPKLLIYKASKSHTGVPSRFSGSGSGTDFTLTISS LQPEDFATYYCQQGQSYPYTFGQGTKLEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 569 |

Figure 54

| Antibody | Date | $K_D$ ± 95% Confidence Interval of the Fit |
|---|---|---|
| BM26 | 12/12/2016 | 490 pM ± 80 pM |
| BM29 | 12/12/2016 | 760 pM ± 180 pM |
| CPA.9.027 | 10/18/2016 | 170 pM ± 40 pM |
| CPA.9.049 | 7/21/2016 | 260 pM ± 170 pM |
| CPA.9.059 | 10/18/2016 | 290 pM ± 110 pM |
| CHA.9.536 | 12/12/2016 | 880 pM ± 260 pM |
| CHA.9.541 | 12/12/2016 | 1.24 nM ± 470 pM |
| CHA.9.543 | 12/12/2016 | 10.2 nM ± 3.27 nM |
| CHA.9.546 | 12/12/2016 | 1.22 nM ± 390 pM |
| CHA.9.547 | 12/12/2016 | 720 pM ± 200 pM |
| CHA.9.560 | 12/12/2016 | 1.02 nM ± 210 pM |

Figure 55

| Antibody | Date | $K_D$ ± 95% Confidence Interval of the Fit |
|---|---|---|
| BM26 | 12/12/2016 | 670 pM ± 240 pM |
| BM29 | 12/12/2016 | Not Reliable Fit |
| CPA.9.027 | 10/18/2016 | 2.25 nM ± 760 pM |
| CPA.9.049 | 7/21/2016 | 1.88 nM ± 1.09 nM |
| CPA.9.059 | 9/2/2016 | No Binding |
| CHA.9.536 | 12/12/2016 | 2.15 nM ± 590 pM |
| CHA.9.541 | 12/12/2016 | 2.09 nM ± 280 pM |
| CHA.9.543 | 12/12/2016 | 17.2 nM ± 3.82 nM |
| CHA.9.546 | 12/12/2016 | 1.36 nM ± 270 pM |
| CHA.9.547 | 12/12/2016 | 1.40 nM ± 390 pM |
| CHA.9.560 | 12/12/2016 | 1.84 nM ± 140 pM |

Figure 56

| MAb | Human TIGIT ka (/s) | Human TIGIT kd (/M-s) | Human TIGIT KD (M) | Cyno TIGIT ka (/s) | Cyno TIGIT kd (/M-s) | Cyno TIGIT KD (M) | Mouse TIGIT ka (/s) | Mouse TIGIT kd (/M-s) | Mouse TIGIT KD (M) |
|---|---|---|---|---|---|---|---|---|---|
| CPA.9.027 | 1.94E+06 | 2.51E-04 | 1.30E-10 | | Complex Kinetics | | 4.50E+05 | 3.60E-02 | 8.00E-08 |
| CPA.9.049 | 1.68E+06 | 1.58E-04 | 9.45E-11 | | Complex Kinetics | | 4.65E+05 | 3.85E-02 | 8.27E-08 |
| CPA.9.059 | 1.88E+06 | 4.01E-05 | 2.13E-11 | | Complex Kinetics | | | N/A | |
| CHA.9.536 | 8.81E+05 | *1.00E-05 | 1.13E-11 | 1.18E+06 | 2.90E-04 | 2.45E-10 | | No binding | |
| CHA.9.541 | 4.51E+05 | 3.64E-05 | 8.08E-11 | 1.75E+06 | *1.00E-05 | 5.73E-12 | | No binding | |
| CHA.9.543 | 1.97E+06 | 4.54E-05 | 2.31E-11 | 6.46E+06 | *1.00E-05 | 1.55E-12 | | No binding | |
| CHA.9.546 | 1.19E+06 | 2.68E-04 | 2.26E-10 | 2.20E+06 | 1.23E-03 | 5.56E-10 | | No binding | |
| CHA.9.547 | 2.69E+06 | 1.03E-04 | 3.84E-11 | 3.34E+06 | 5.15E-04 | 1.54E-10 | | No binding | |
| CHA.9.560 | 1.04E+06 | 1.59E-06 | *1.52E-12 | 3.05E+06 | 1.90E-04 | 6.23E-11 | | No binding | |
| BM26 | 2.05E+06 | 4.94E-05 | 2.41E-11 | 7.99E+06 | *1.00E-05 | 1.25E-12 | | No binding | |
| BM29 | 1.63E+06 | 2.45E-05 | 1.5E-11 | | Complex | | | No binding | |

Figure 58

| Antibody | 6.7 nM mAb | | 1.3 nM mAb | | 266 pM mAb | |
|---|---|---|---|---|---|---|
| | Blocking (Yes/No) | gMFI | Blocking (Yes/No) | gMFI | Blocking (Yes/No) | gMFI |
| BM26 | Yes | 234 | Yes | 401 | Yes | 719 |
| Synagis | No | 828 | No | 964 | No | 959 |
| CPA.9.027 | Yes | 208 | Yes | 253 | Yes | 529 |
| CPA.9.049 | Yes | 215 | Yes | 276 | Yes | 511 |
| CPA.9.059 | Yes | 209 | Yes | 262 | Yes | 509 |

Figure 59

| Antibody | Date Tested | IC50 (nM) |
|---|---|---|
| BM26 | 12/10/2016 | 0.37 |
| BM29 | 12/10/2016 | 0.60 |
| CHA.9.536 | 12/10/2016 | 0.92 |
| CHA.9.541 | 12/10/2016 | 1.24 |
| CHA.9.546 | 12/10/2016 | 0.63 |
| CHA.9.547 | 12/10/2016 | 0.49 |
| CHA.9.560 | 12/10/2016 | 1.12 |

Figure 66

|  | Average of 3 Donors ||
|---|---|---|
|  | Monotherapy | Combo with CHA.7.518.1 |
| CHA.7.518.1 + hIgG4 Isotype | 43 |  |
| CPA.9.027-H4 | 66 | 142 |
| CPA.9.049-H4 | 51 | 112 |
| CPA.9.059-H4 | 55 | 108 |
| CHA.7.518.1 + mIgG1 Isotype | 39 |  |
| CHA.9.536-M1 | 43 | 100 |
| CHA.9.541-M1 | 39 | 93 |
| CHA.9.543-M1 (Non-blocker) | 27 | 65 |
| CHA.9.546-M1 | 43 | 103 |
| CHA.9.547-M1 | 47 | 96 |
| CHA.9.560-M1 | 38 | 94 |
| BM26 | 49 | 107 |

Figure 68

Box 1 (top left):
- 25 CHA.9.536
- 20 CHA.9.522
- 6 CPA.9.015-H4

Box 2:
- 2 CPA.9.011-H4
- 40 BM8-H4

Box 3:
- 15 CPA.9.071-H4

Central large box:
- 27 CHA.9.546
- 3 CPA.9.012-H4
- 28 CHA.9.547
- 4 CPA.9.013-H4
- 7 CPA.9.018-H4
- 44 MB5A43-M1
- 46 Sino PVR-Fc (ligand)
- 32 CHA.9.555
- 45 PVR-Fc M2A (ligand)
- 43 BM29-H4
- 8 CPA.9.027-H4
- 9 CPA.9.049-H4
- 10 CPA.9.053-H4

Box:
- 13 CPA.9.064-H4

Box:
- 42 BM26-H4

Box:
- 12 CPA.9.059-H4

Box:
- 24 CHA.9.535
- 1 CPA.9.009-H4

Box:
- 33 CHA.9.560
- 22 CHA.9.528

Box:
- 30 CHA.9.552
- 19 CHA.9.521
- 26 CHA.9.541
- 23 CHA.9.529
- 18 CHA.9.519
- 21 CHA.9.527
- 29 CHA.9.549

Box:
- 11 CPA.9.057-H4
- 31 CHA.9.554

Bottom box:
- 41 BM9-H4
- 34 CHA.9.525
- 17 CPA.9.081-H4
- 35 CHA.9.538
- 37 CHA.9.553
- 14 CPA.9.069-H4
- 36 CHA.9.543
- 38 CHA.9.556
- 16 CPA.9.077-H4
- 39 CHA.9.561

| Anti-TIGIT Ab | K_D CD8+ Tem Donor 1 (nM) | K_D CD8+ Tem Donor 3 (nM) |
|---|---|---|
| CPA.9.083 | 0.82 | 0.88 |
| CPA.9.086 | 0.43 | 0.98 |
| CPA.9.103 | 31 | 25 |
| CHA.9.547.1 | 25 | 19 |
| BM26 | 4.6 | 7.5 |

FIGURE 74

| Name | Human TIGIT-His | | | Cyno TIGIT-His | | | Mouse TIGIT-His | | |
|---|---|---|---|---|---|---|---|---|---|
| | $k_a$ (/s) | $k_d$ (/M·s) | $K_D$ (pM) | $k_a$ (/s) | $k_d$ (/M·s) | $K_D$ (pM) | $k_a$ (/s) | $k_d$ (/M·s) | $K_D$ (pM) |
| CPA.9.083 | 6.00E+06 | 1.00E-05 | 1.7 | Complex kinetics | | | 2.73E+06 | 1.19E-03 | 434 |
| CPA.9.086 | 4.40E+06 | 1.00E-05 | 2.3 | Complex kinetics | | | 1.83E+06 | 1.21E-03 | 663 |
| CPA.9.103 | 2.48E+06 | 1.60E-05 | 6.4 | 1.63E+06 | 5.50E-04 | 337 | 1.60E+07 | 0.4 | 25,000 |
| CHA.9.547.1 | 2.47E+06 | 2.42E-04 | 98 | 1.03E+06 | 1.17E-03 | 1131 | No binding | | |
| CHA.9.547.7 | 1.60E+06 | 5.51E-05 | 35 | 7.45E+05 | 3.40E-04 | 456 | No binding | | |
| BM26 | 2.50E+06 | 1.00E-05 | 4.0 | 2.83E+06 | 1.00E-05 | 3.5 | No binding | | |
| BM29 | 9.10E+05 | 1.00E-05 | 11 | 3.45E+06 | 5.30E-03 | 1537 | No binding | | |

Figure 77
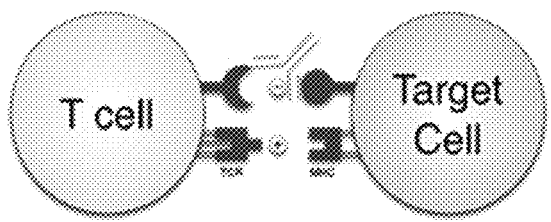
TIGIT/PVRIG  PVR/PVRL2
CMV-specific         Peptide pulsed
CD8+ T-cells         Panc.05.04 Cells
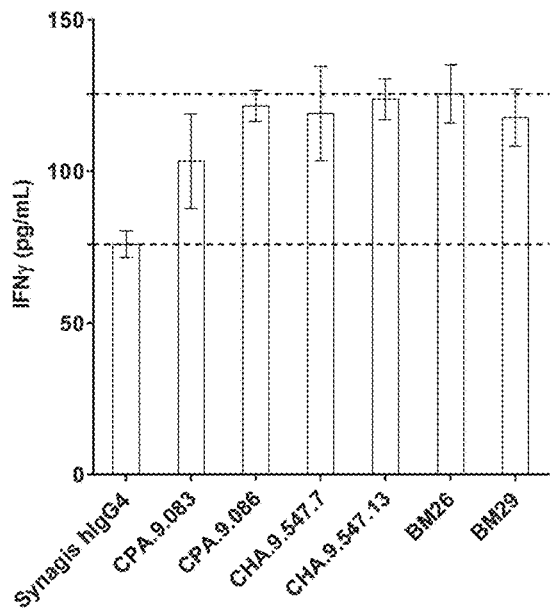
| | Donor 4 (n=1) | Donor 4 (n=2) |
|---|---|---|
| CPA.9.083 | 36 | 111 |
| CPA.9.086 | 60 | 100 |
| CHA.9.547.7 | 57 | 125 |
| CHA.9.547.13 | 63 | 108 |
| BM26 | 65 | 84 |
| BM29 | 55 | 103 |

Figure 79
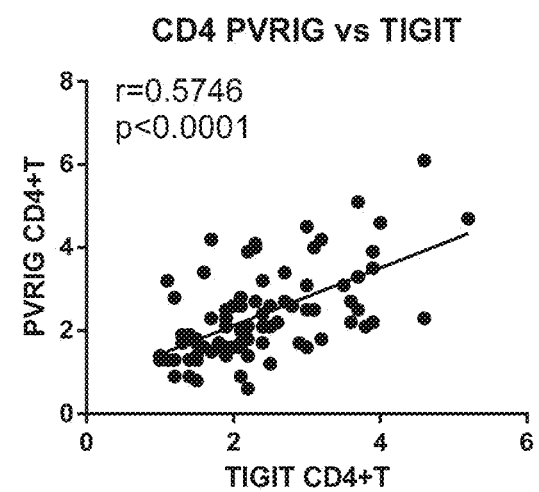
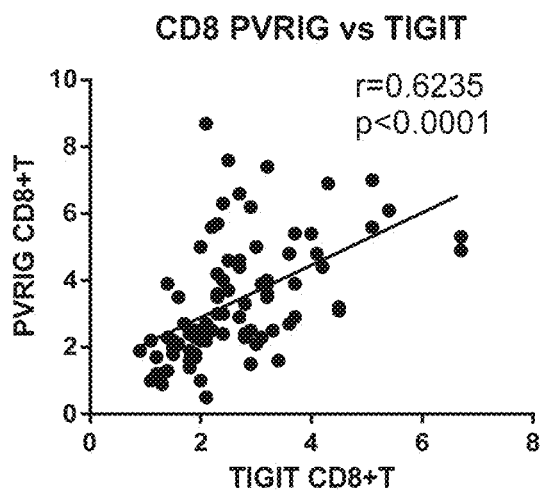

FIG. 80A
A.
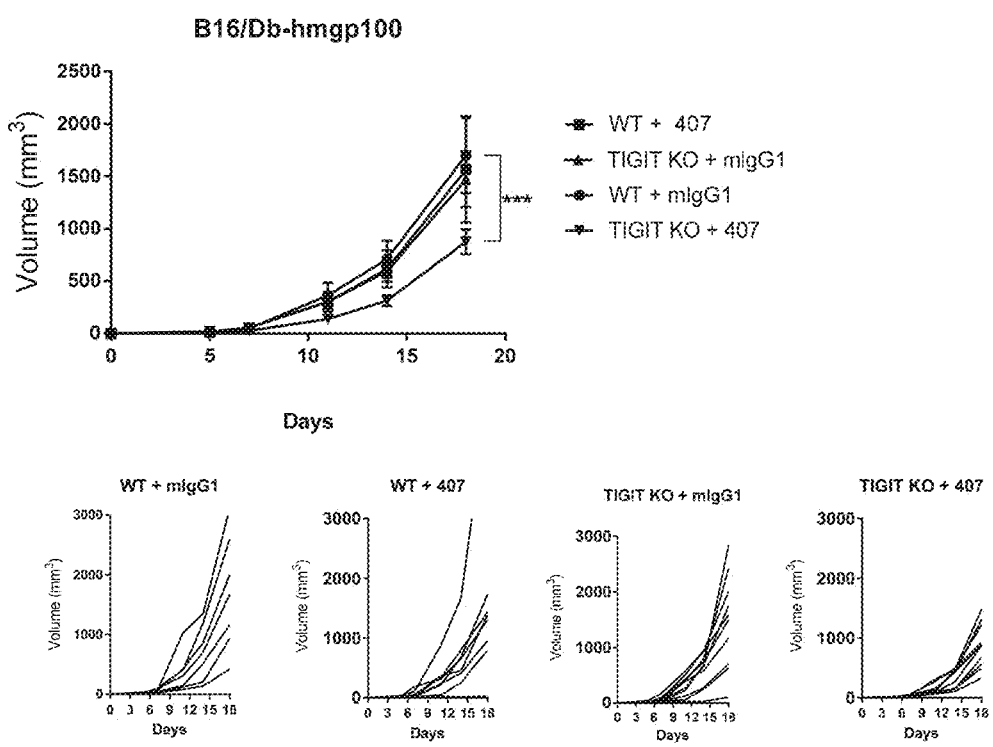
FIG. 80B
B.
| TGI compared to WT + mIgG1 | Day 11 | Day 14 | Day 18 |
|---|---|---|---|
| WT + 407 | 17% | 13% | 6% |
| TIGIT-KO + mIgG1 | 17% | 17% | 13% |
| TIGIT-KO + 407 | 63% | 53% | 49% |
FIG. 80C
C.
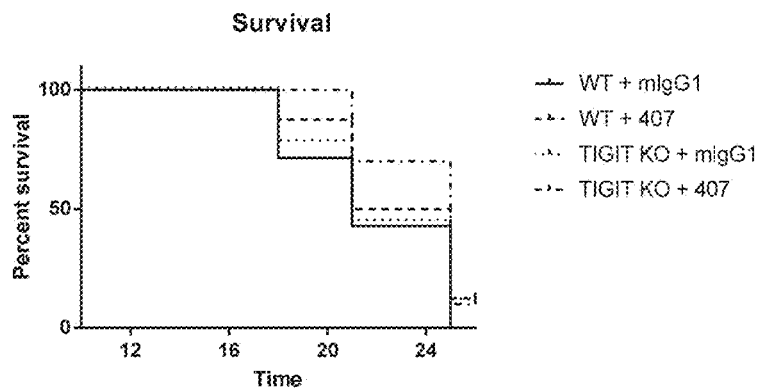

Figure 81
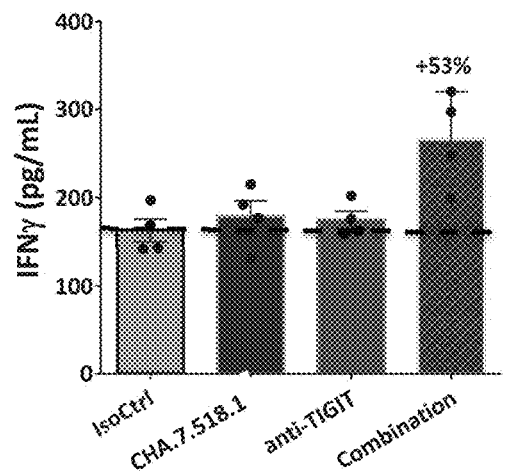
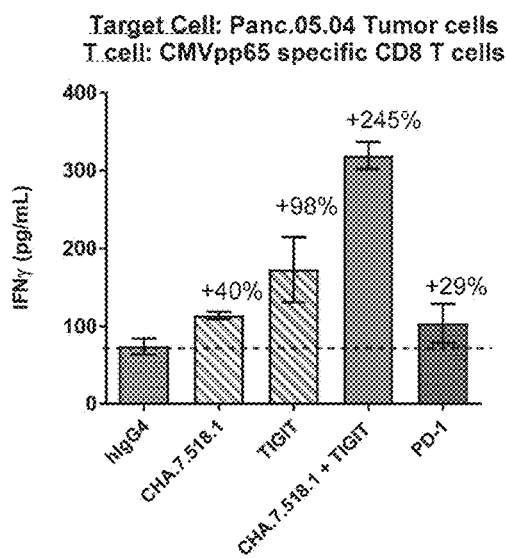
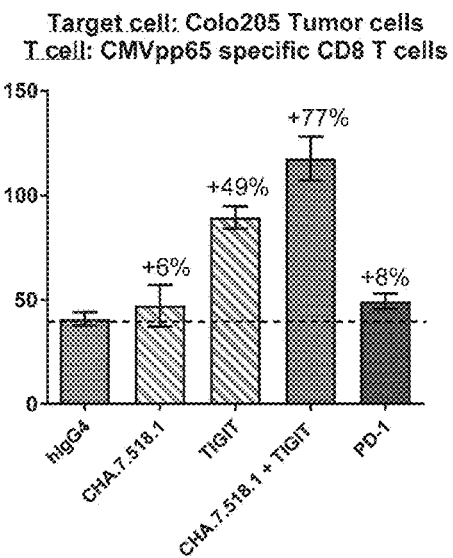

A) T cells

B)

Colo205 PDL1 Low

Panc 05.04 PDL1 High

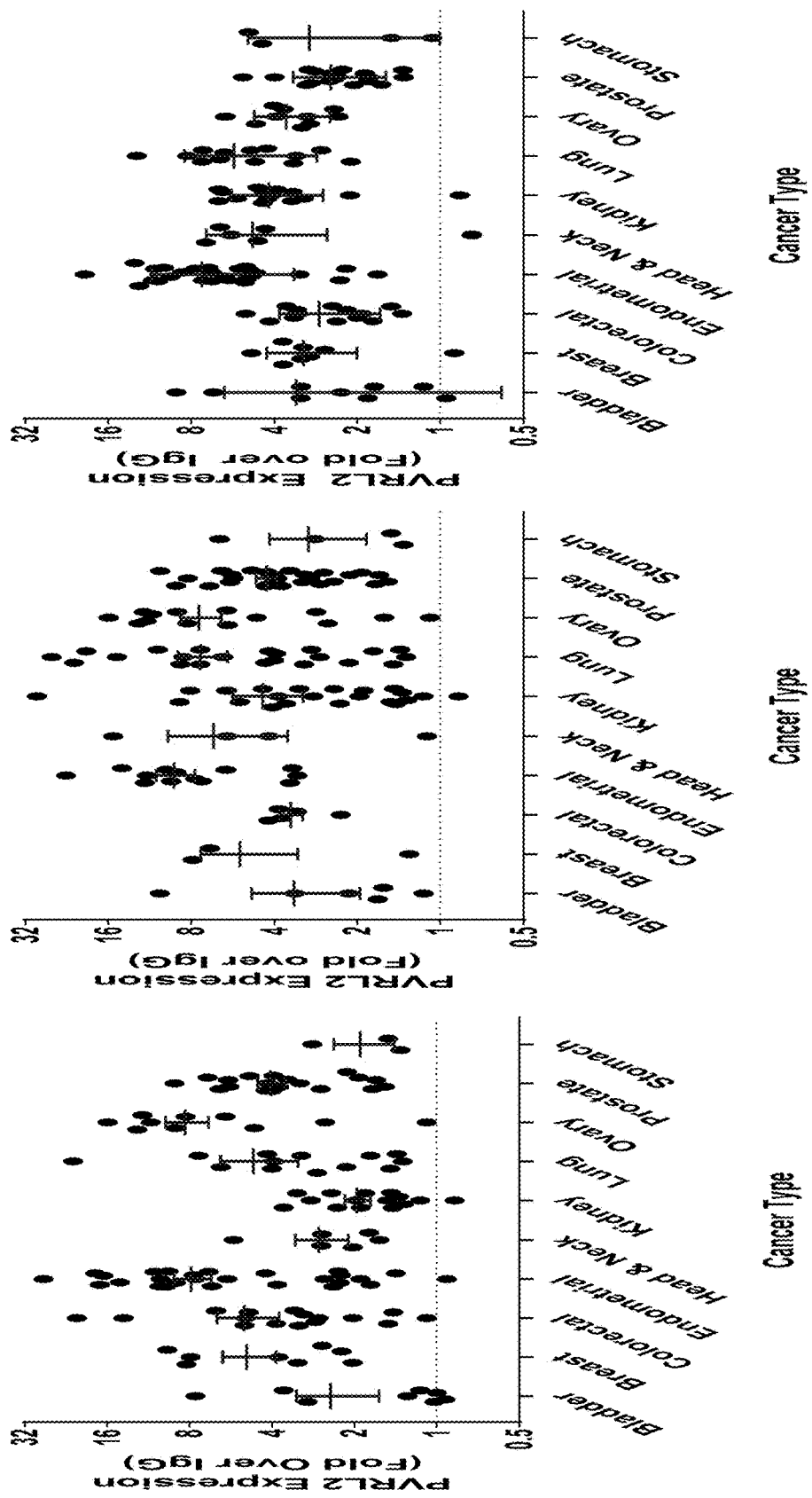

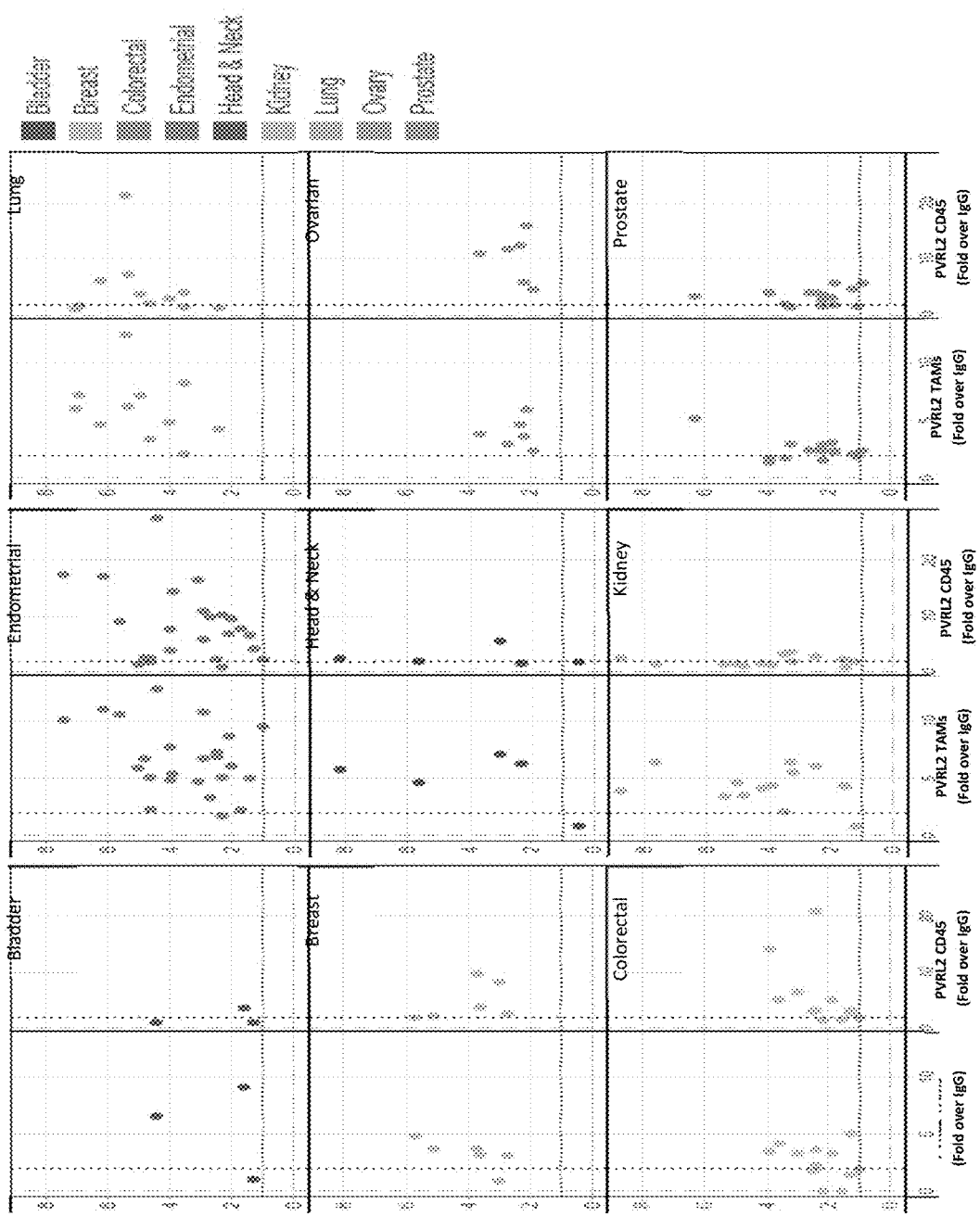
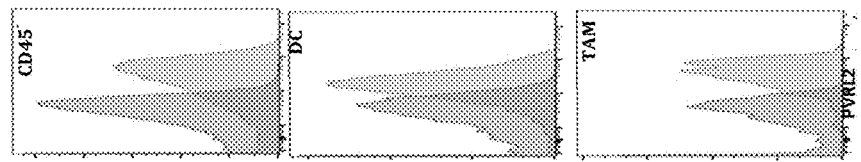
FIG. 84E
FIG. 84D

| Tissue Type | All Tumors | | | PD-L1+ | | | PD-L1- | | |
|---|---|---|---|---|---|---|---|---|---|
| | PVRL2+ | Total | % Positive | PVRL2+ | Total | % Positive | PVRL2+ | Total | % Positive |
| Lung | | | | | | | | | |
| Normal | 1 | 4 | 25 | N/A | N/A | N/A | N/A | N/A | N/A |
| Adenocarcinoma | 8 | 14 | 57 | 3 | 5 | 60 | 5 | 9 | 56 |
| Squamous cell carcinoma | 8 | 13 | 62 | 5 | 7 | 71 | 3 | 6 | 50 |
| Ovarian | | | | | | | | | |
| Normal | 0 | 2 | 0 | N/A | N/A | N/A | N/A | N/A | N/A |
| Serous cystadenocarcinoma | 8 | 12 | 67 | 2 | 3 | 67 | 6 | 9 | 67 |
| Mucinous cystadenocarcinoma | 4 | 6 | 67 | 1 | 1 | 100 | 3 | 5 | 60 |
| Endometrioid adenocarcinoma | 8 | 12 | 67 | 3 | 4 | 75 | 5 | 8 | 63 |
| Colon | | | | | | | | | |
| Normal | 0 | 2 | 0 | N/A | N/A | N/A | N/A | N/A | N/A |
| Adenocarcinoma | 16 | 30 | 53 | 8 | 14 | 57 | 7 | 16 | 44 |
| Skin | | | | | | | | | |
| Normal | 0 | 4 | 0 | N/A | N/A | N/A | N/A | N/A | N/A |
| Melanoma-Primary | 3 | 24 | 13 | 1 | 4 | 25 | 2 | 20 | 10 |
| Metastatic melanoma | 1 | 12 | 8 | 1 | 4 | 25 | 0 | 8 | 0 |
| Renal | | | | | | | | | |
| Normal | 0 | 3 | 0 | N/A | N/A | N/A | N/A | N/A | N/A |
| Clear cell carcinoma | 8 | 20 | 40 | 0 | 0 | N/A | 8 | 20 | 40 |
| Papillary renal cell carcinoma | 2 | 7 | 29 | 1 | 1 | 100 | 1 | 6 | 17 |
| Breast | | | | | | | | | |
| TNBC | 1 | 3 | 33 | 0 | 0 | N/A | 1 | 3 | 33 |
| Invasive ductal carcinoma | 19 | 30 | 63 | 6 | 10 | 60 | 13 | 20 | 65 |

FIG. 84F

FIG. 85A
FIG. 85B
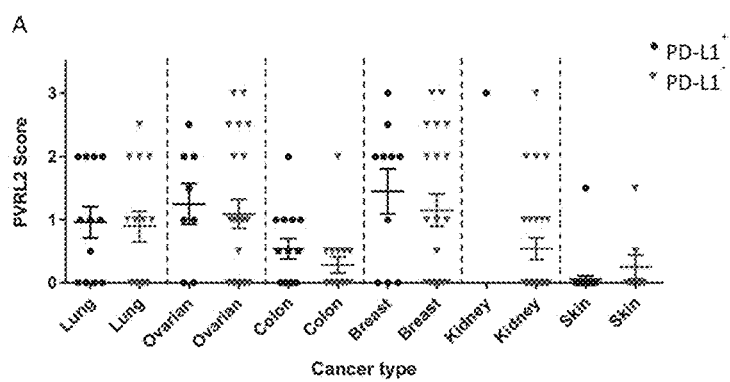
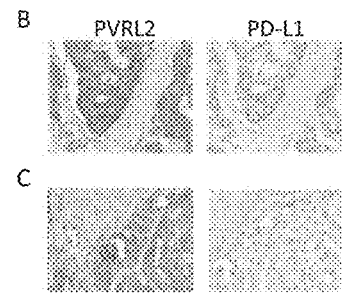
FIG. 85C
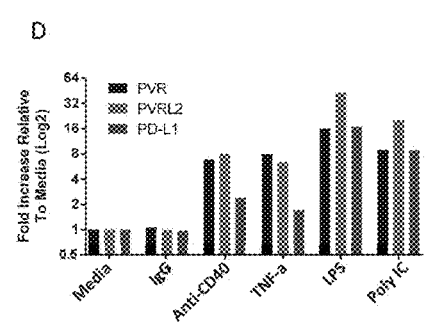
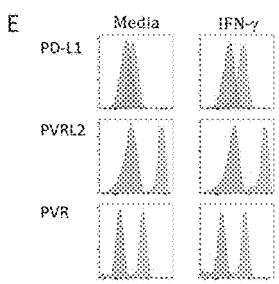
FIG. 85D
FIG. 85E

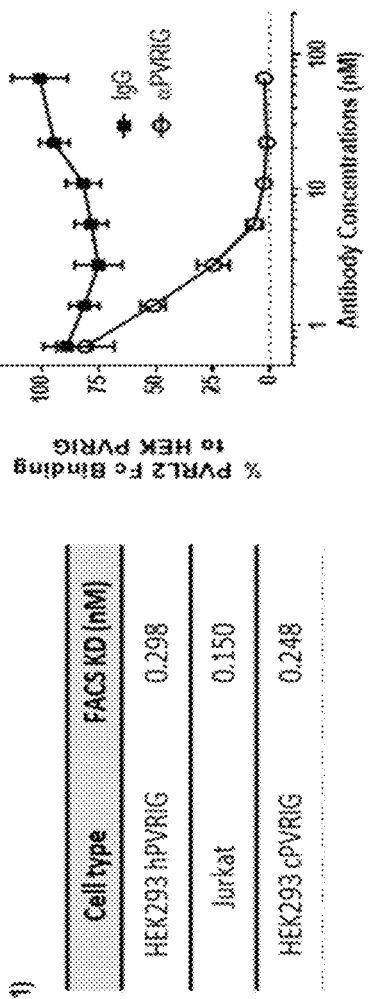
FIG. 86A
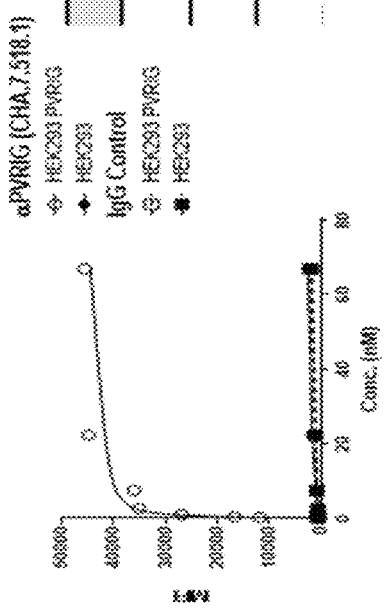
FIG. 86B
FIG. 86C
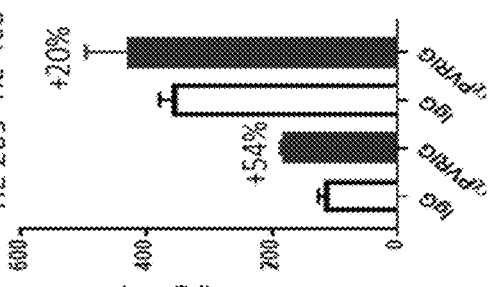
FIG. 86D
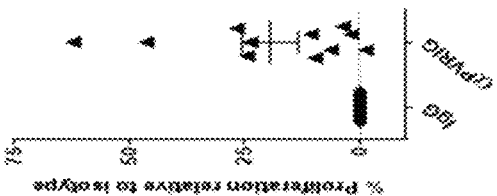
FIG. 86E
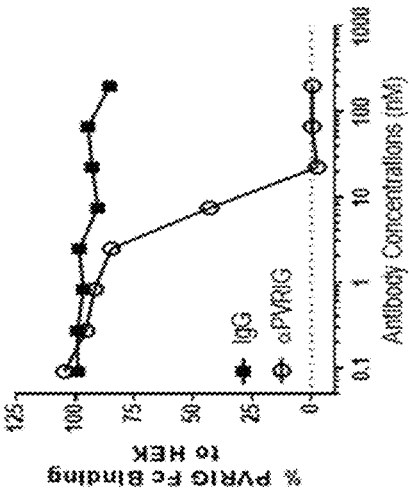

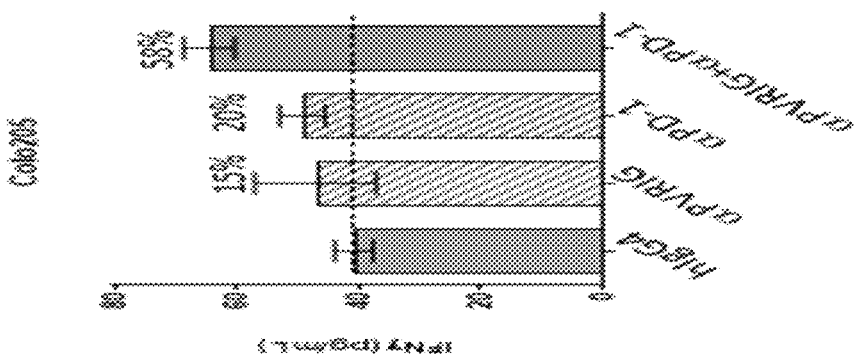
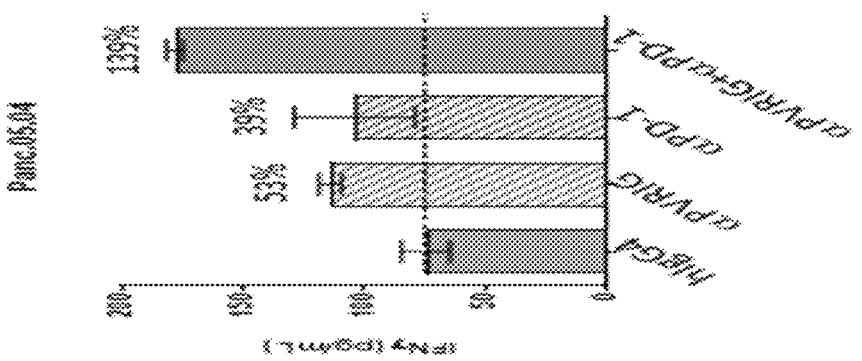
FIG. 86I
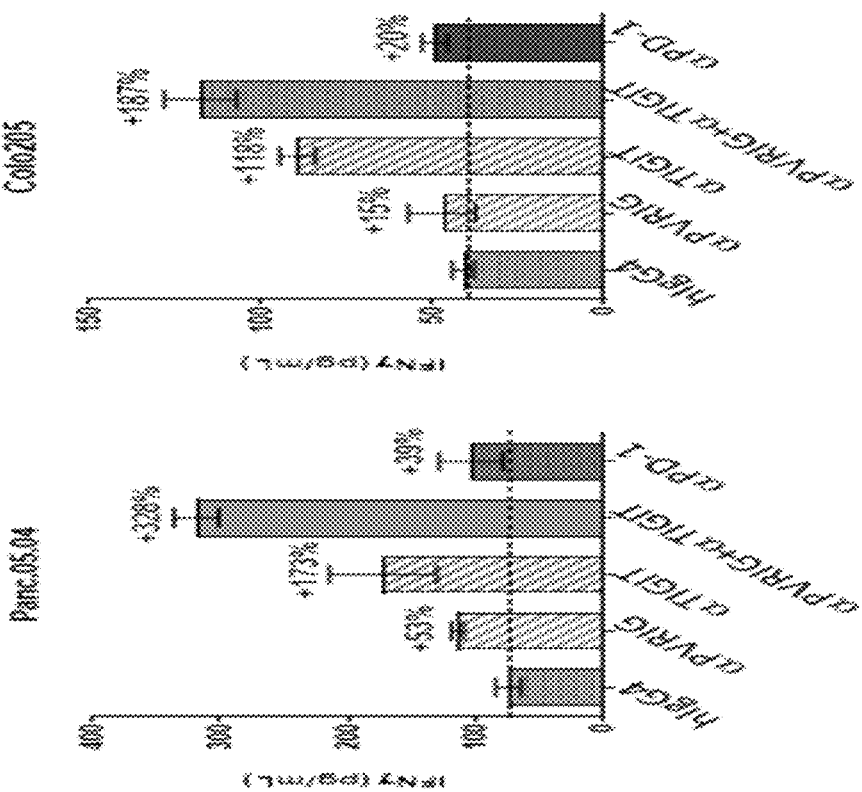
FIG. 86H

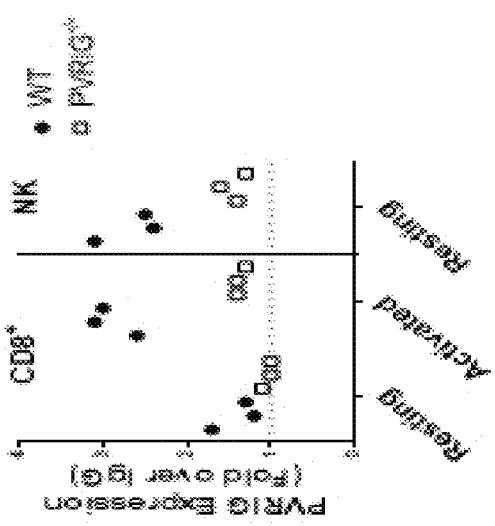
FIG. 87C
FIG. 87B
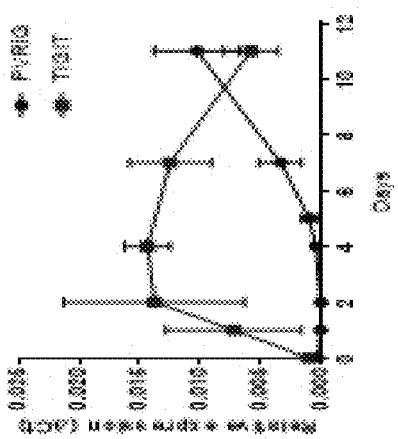
FIG. 87A
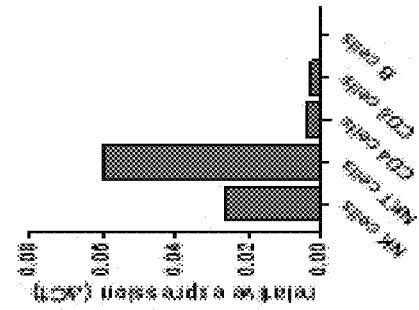
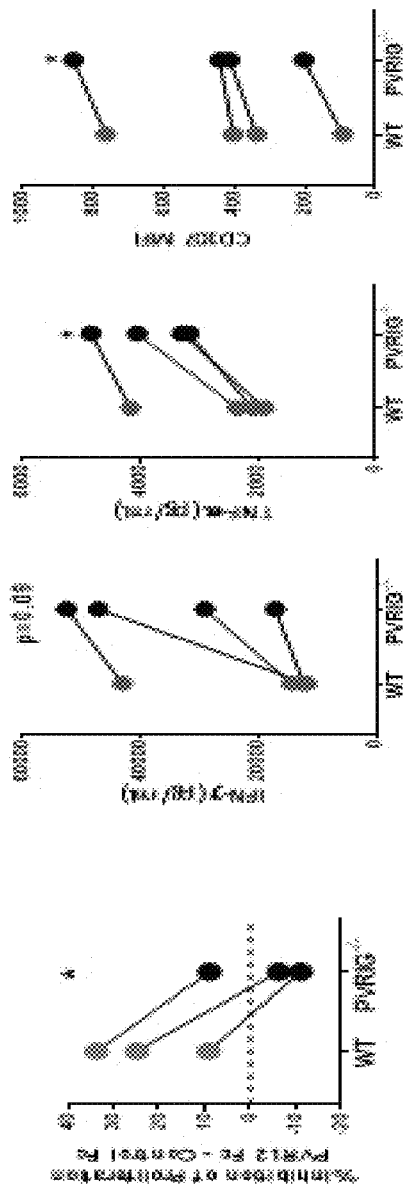
FIG. 87E
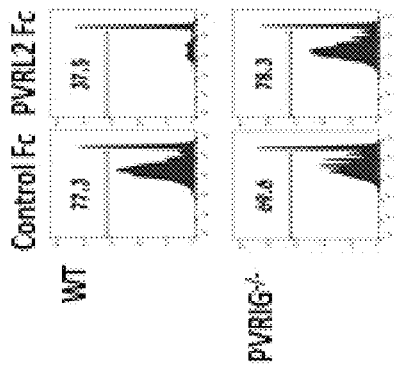
FIG. 87D FIG. 88A
FIG. 88B
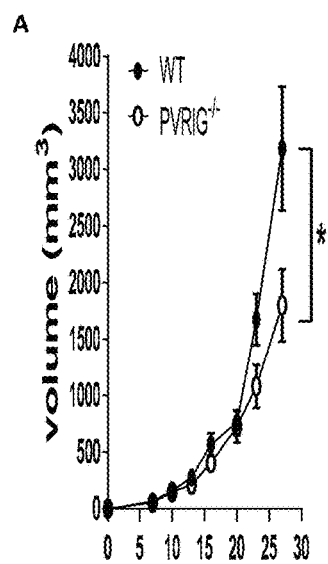
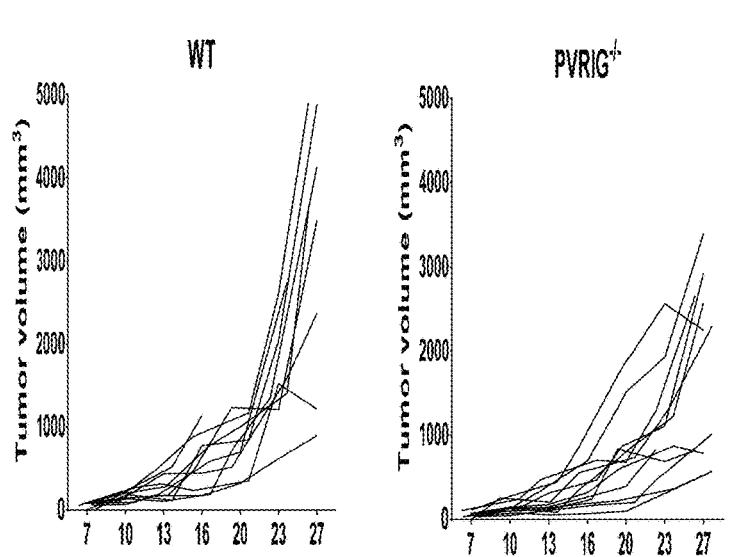
FIG. 88C
FIG. 88D
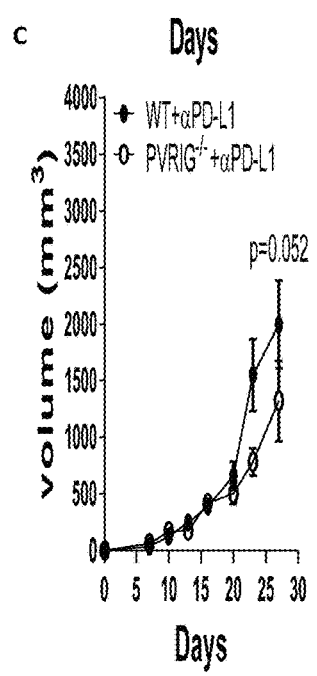
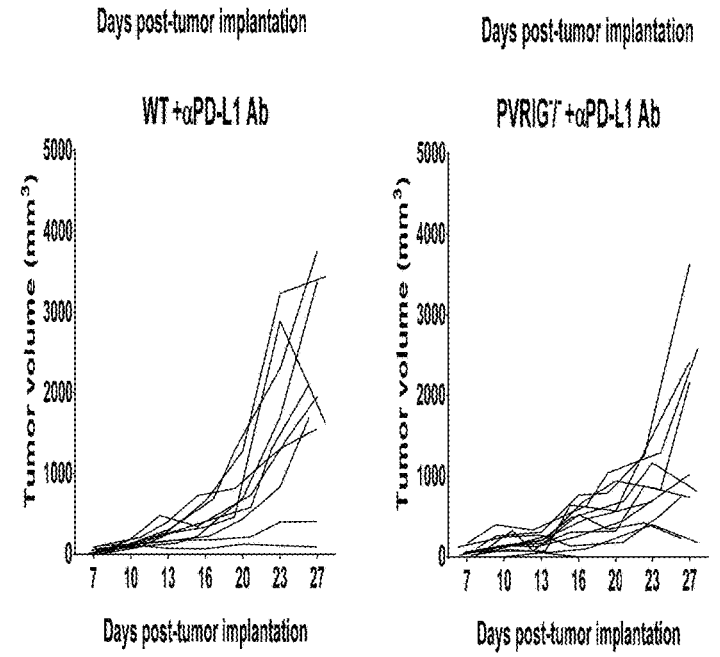

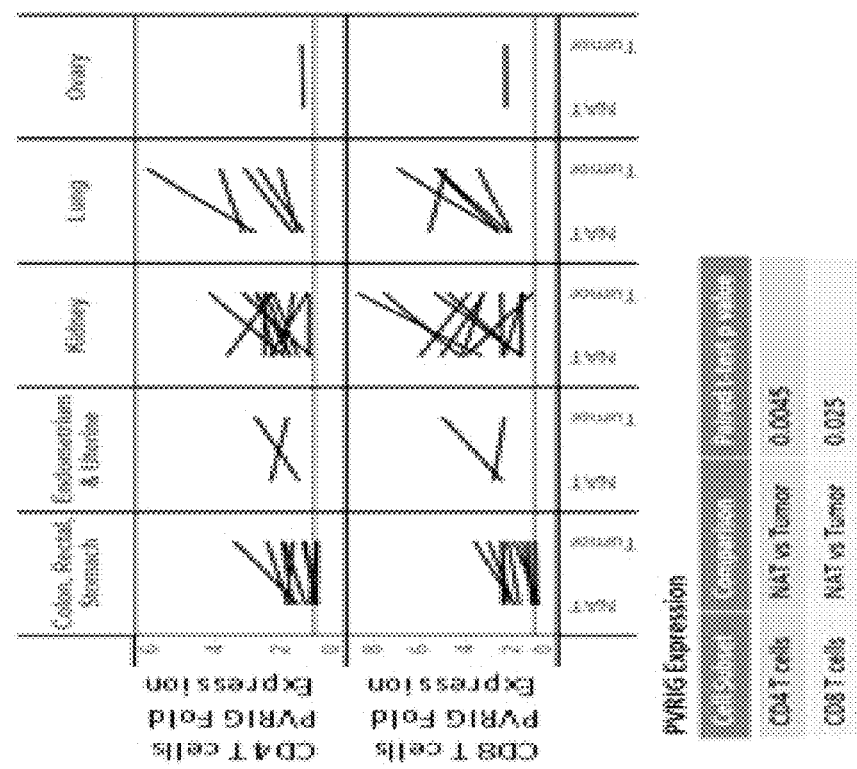
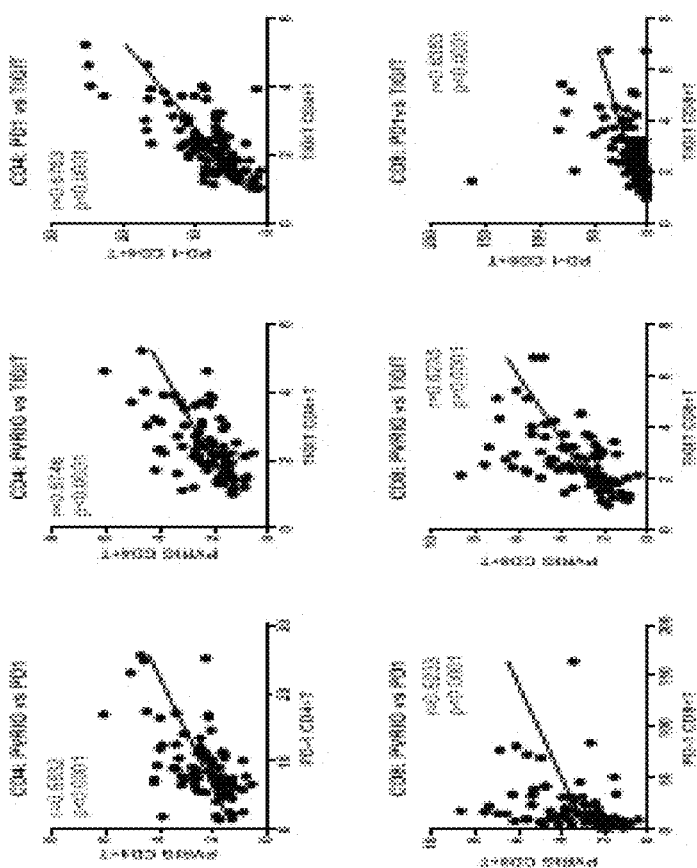
FIG. 90E
FIG. 90F

Figure 92
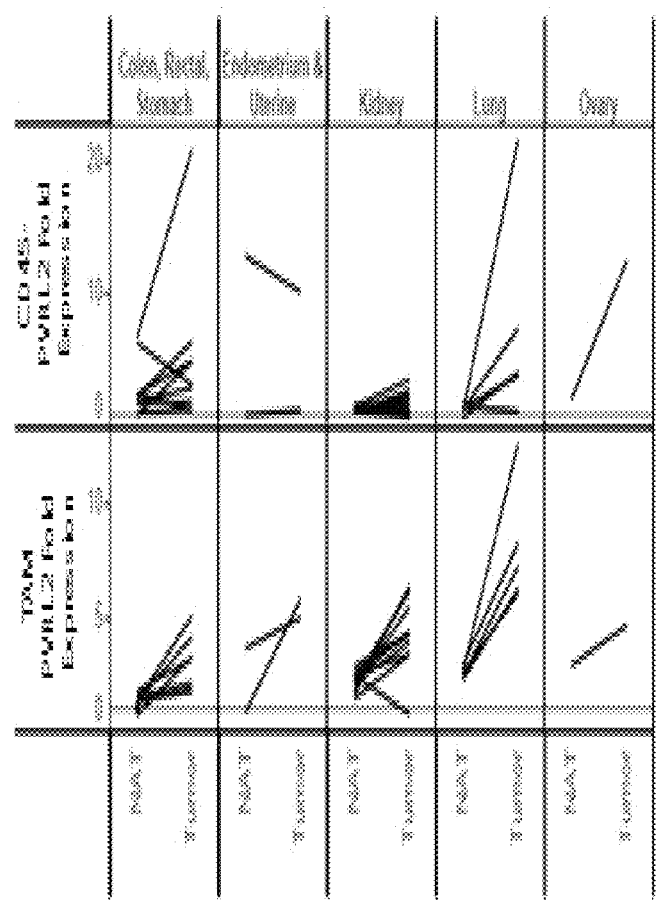
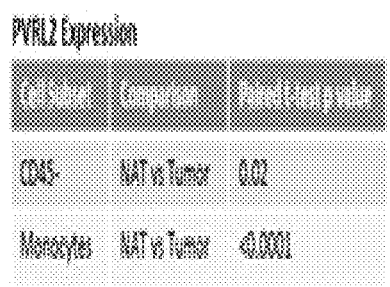

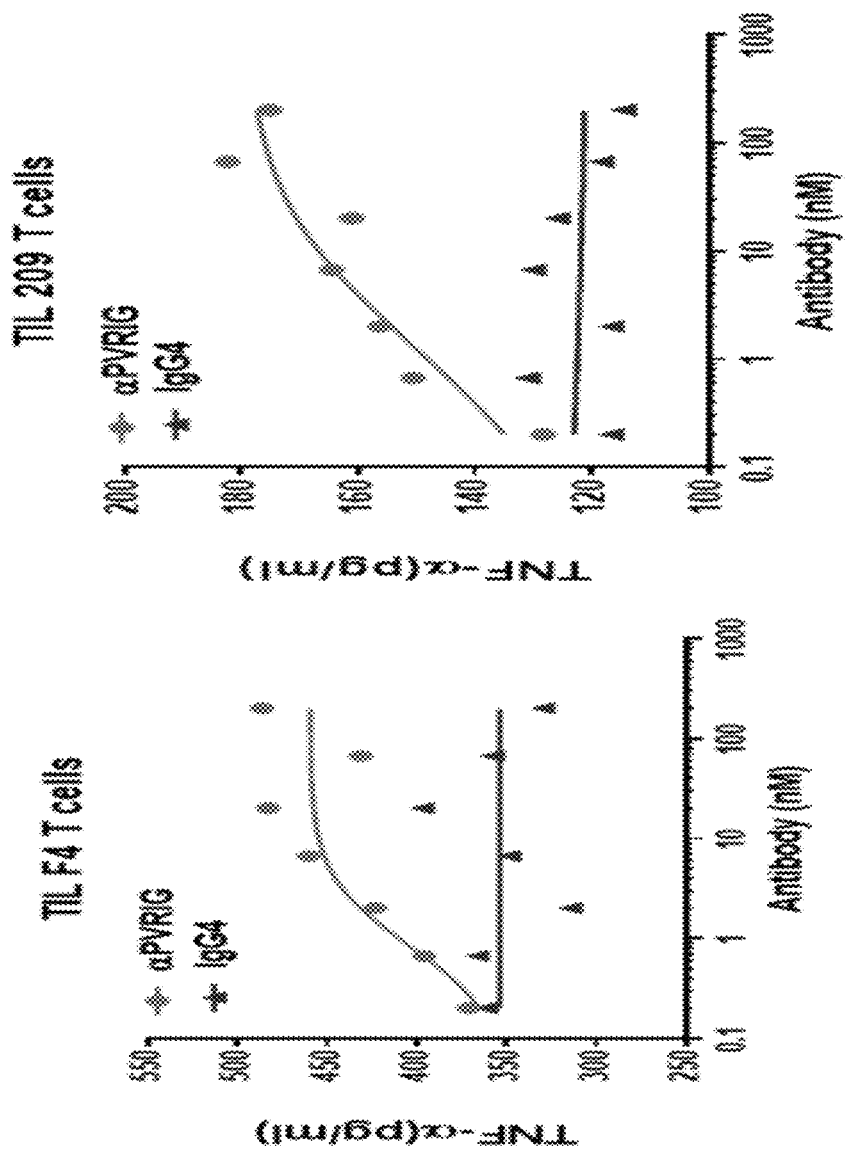
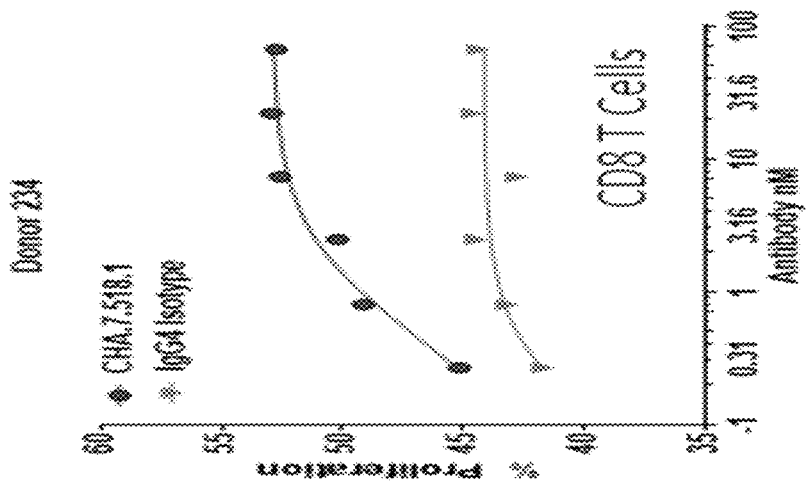
FIG. 94D
FIG. 94C

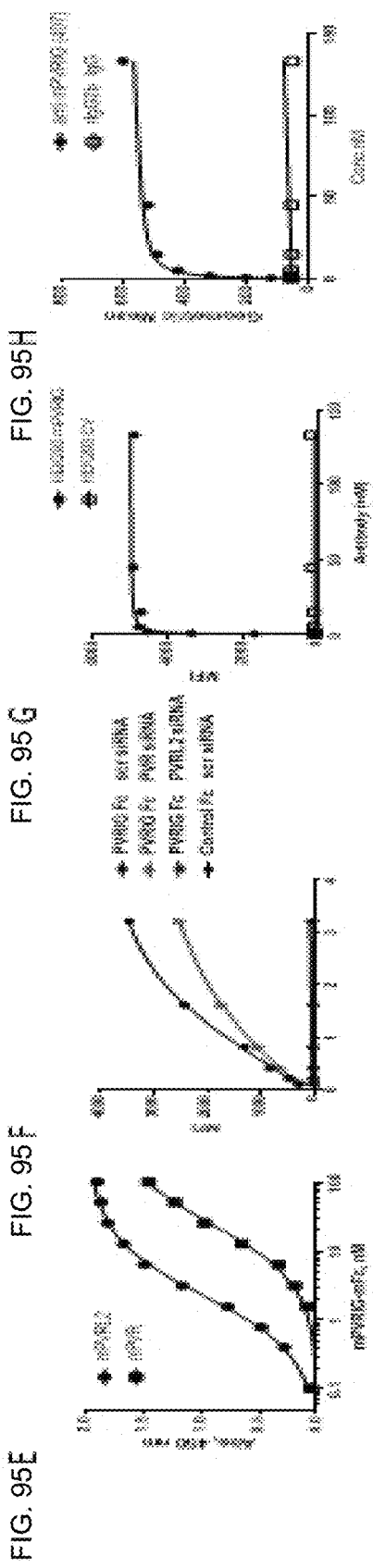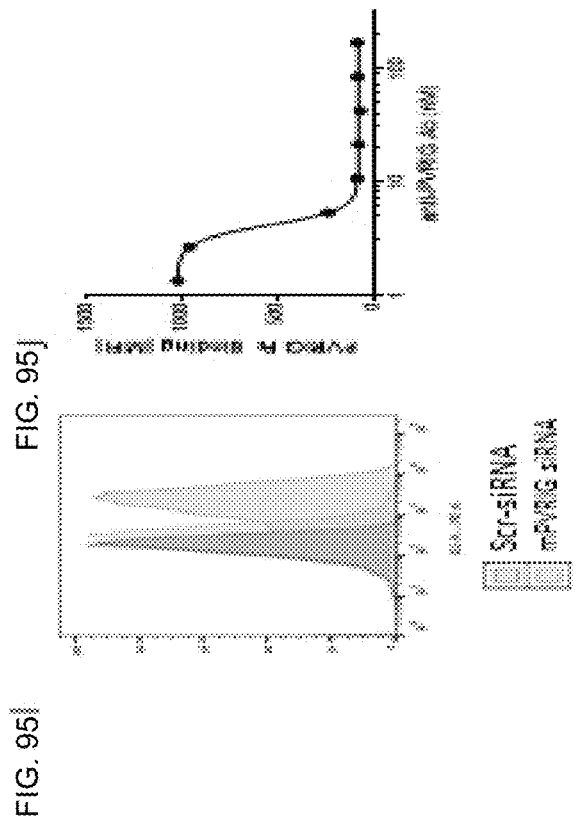

Figure 96
A
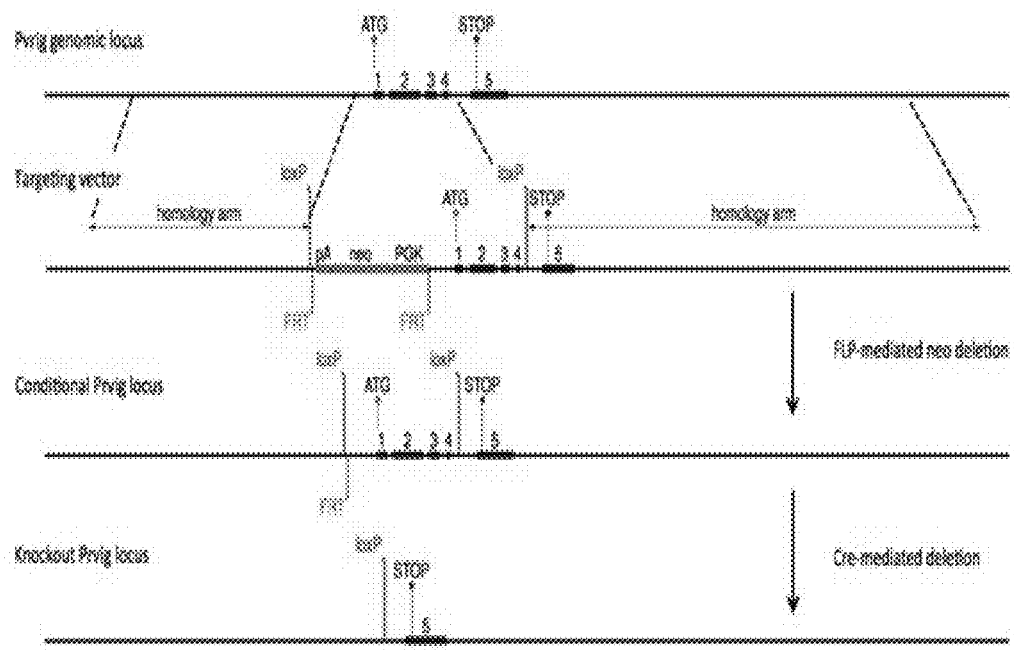
B
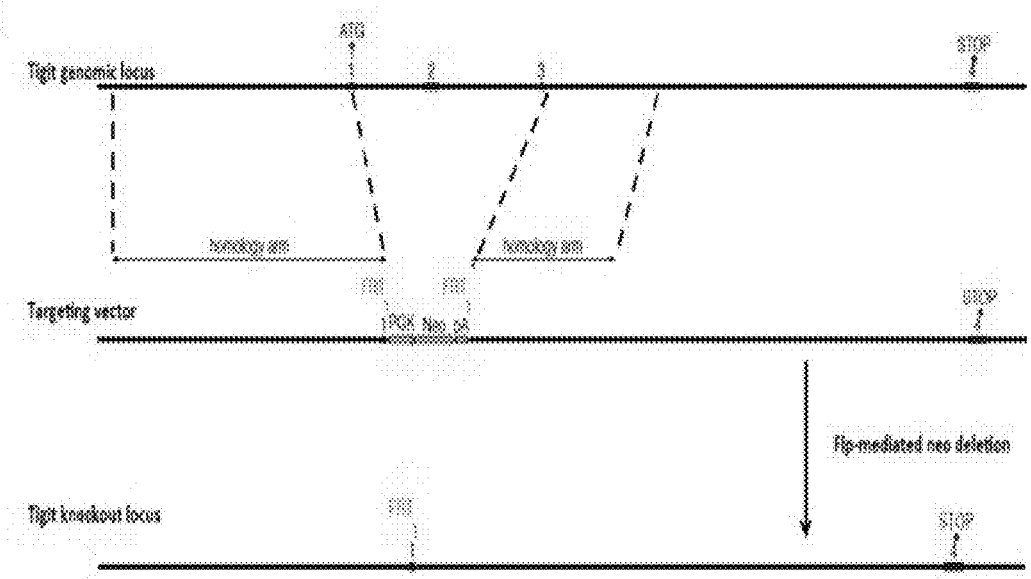

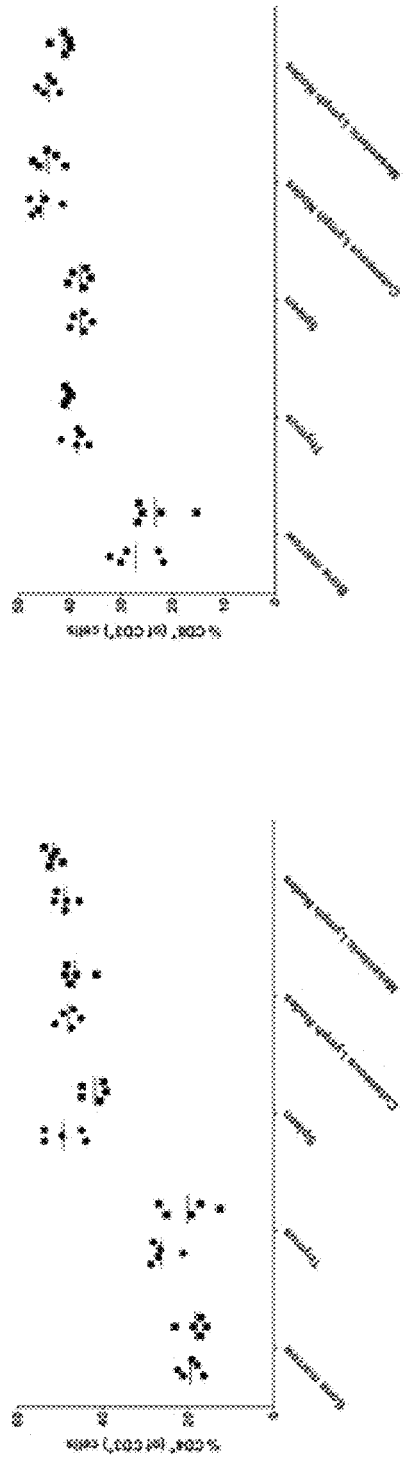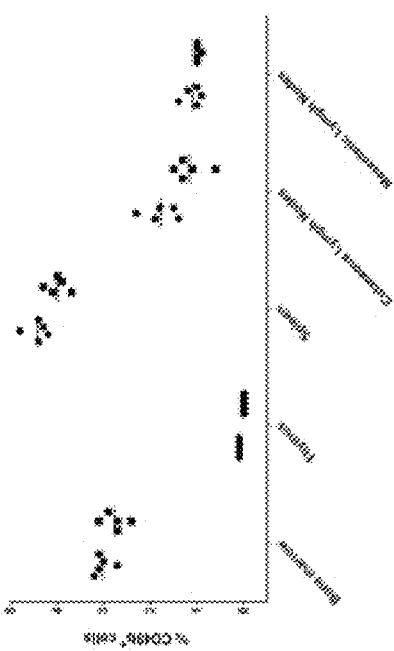

Figure 99
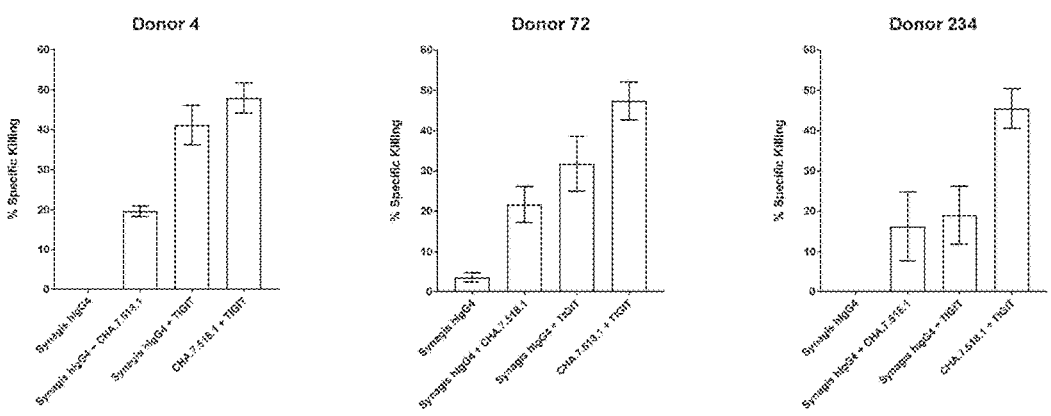
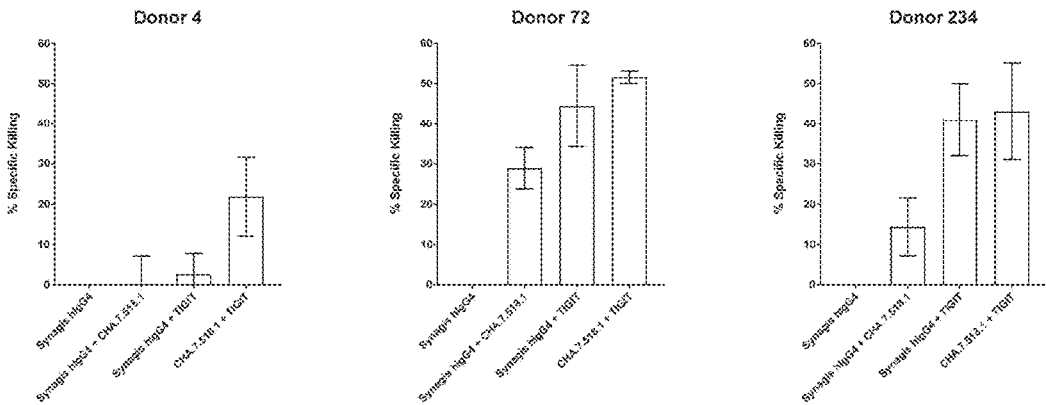

Figure 101

CPA9.086 CDR sequences

| Definition | H-CDR1 | H-CDR2 | H-CDR3 | L-CDR1 | L-CDR2 | L-CDR3 |
|---|---|---|---|---|---|---|
| IMGT | GFTFSSYA (SEQ ID NO:600) | ISYAGEVK (SEQ ID NO:601) | ARDPLPLHYYGMDV (SEQ ID NO:602) | SSNMGRRP (SEQ ID NO:603) | SQN (SEQ ID NO:604) | AVWDDIGRVLQ (SEQ ID NO:605) |
| Kabat | SYAMH (SEQ ID NO:606) | VISYAGEVKYYADSVKG (SEQ ID NO:607) | DPLPLHYYGMDV (SEQ ID NO:608) | SGSSSNMGRRPVN (SEQ ID NO:609) | SQNQRPS (SEQ ID NO:610) | AVWDDIGRVLQ (SEQ ID NO:611) |

Figure 102
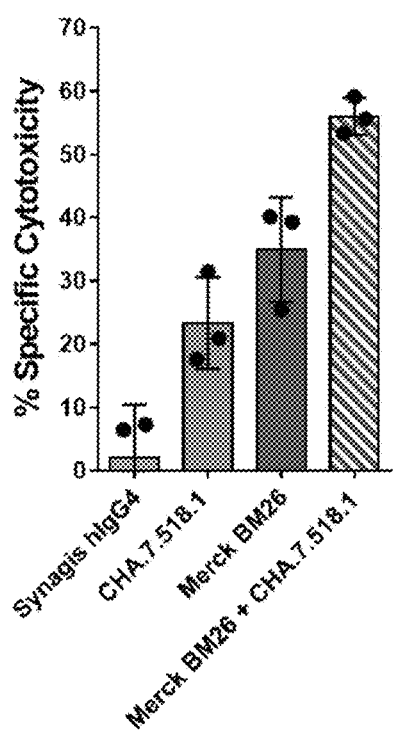
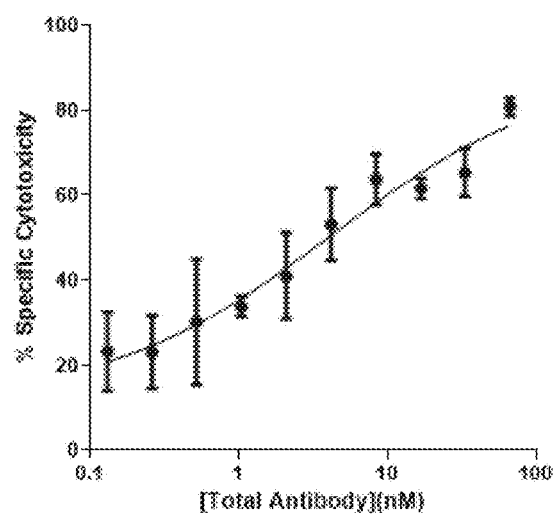
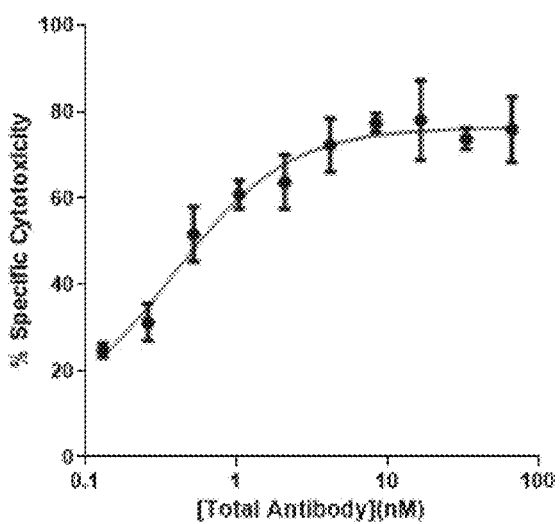

ANTI-TIGIT ANTIBODIES, ANTI-PVRIG ANTIBODIES AND COMBINATIONS THEREOF

I. RELATED APPLICATIONS

This application is a continuation of U.S. patent application Ser. No. 15/680,187, filed on Aug. 17, 2017 which claims priority to U.S. Application Ser. No. 62/376,334, filed on Aug. 17, 2016, U.S. Application Ser. No. 62/513,771 filed on Jun. 1, 2017, U.S. Application Ser. No. 62/376,335, filed on Aug. 17, 2016, U.S. Application Ser. No. 62/417,217, filed on Nov. 3, 2016, U.S. Application Ser. No. 62/513,775, filed on Jun. 1, 2017, U.S. Application Ser. No. 62/477,974, filed on Mar. 28, 2017, U.S. Application Ser. No. 62/513,916, filed on Jun. 1, 2017, and U.S. Application Ser. No. 62/538,561, filed on Jul. 28, 2017, all of which are incorporated by reference herein in their entireties.

SEQUENCE LISTING

The instant application contains a Sequence Listing which has been submitted electronically in ASCII format and is hereby incorporated by reference in its entirety. Said ASCII copy, created on Oct. 25, 2017 and amended on Feb. 7, 2018, is named 114386-5008-US01_ST25_V2.txt and is 593,420 bytes in size.

II. BACKGROUND OF THE INVENTION

Naïve T cells must receive two independent signals from antigen-presenting cells (APC) in order to become productively activated. The first, Signal 1, is antigen-specific and occurs when T cell antigen receptors encounter the appropriate antigen-MHC complex on the APC. The fate of the immune response is determined by a second, antigen-independent signal (Signal 2) which is delivered through a T cell costimulatory molecule that engages its APC-expressed ligand. This second signal could be either stimulatory (positive costimulation) or inhibitory (negative costimulation or coinhibition). In the absence of a costimulatory signal, or in the presence of a coinhibitory signal, T-cell activation is impaired or aborted, which may lead to a state of antigen-specific unresponsiveness (known as T-cell anergy), or may result in T-cell apoptotic death.

Costimulatory molecule pairs usually consist of ligands expressed on APCs and their cognate receptors expressed on T cells. The prototype ligand/receptor pairs of costimulatory molecules are B7/CD28 and CD40/CD40L. The B7 family consists of structurally related, cell-surface protein ligands, which may provide stimulatory or inhibitory input to an immune response. Members of the B7 family are structurally related, with the extracellular domain containing at least one variable or constant immunoglobulin domain.

Both positive and negative costimulatory signals play critical roles in the regulation of cell-mediated immune responses, and molecules that mediate these signals have proven to be effective targets for immunomodulation. Based on this knowledge, several therapeutic approaches that involve targeting of costimulatory molecules have been developed, and were shown to be useful for prevention and treatment of cancer by turning on, or preventing the turning off, of immune responses in cancer patients and for prevention and treatment of autoimmune diseases and inflammatory diseases, as well as rejection of allogenic transplantation, each by turning off uncontrolled immune responses, or by induction of "off signal" by negative costimulation (or coinhibition) in subjects with these pathological conditions.

Manipulation of the signals delivered by B7 ligands has shown potential in the treatment of autoimmunity, inflammatory diseases, and transplant rejection. Therapeutic strategies include blocking of costimulation using monoclonal antibodies to the ligand or to the receptor of a costimulatory pair, or using soluble fusion proteins composed of the costimulatory receptor that may bind and block its appropriate ligand. Another approach is induction of co-inhibition using soluble fusion protein of an inhibitory ligand. These approaches rely, at least partially, on the eventual deletion of auto- or allo-reactive T cells (which are responsible for the pathogenic processes in autoimmune diseases or transplantation, respectively), presumably because in the absence of costimulation (which induces cell survival genes) T cells become highly susceptible to induction of apoptosis. Thus, novel agents that are capable of modulating costimulatory signals, without compromising the immune system's ability to defend against pathogens, are highly advantageous for treatment and prevention of such pathological conditions.

Costimulatory pathways play an important role in tumor development. Interestingly, tumors have been shown to evade immune destruction by impeding T cell activation through inhibition of co-stimulatory factors in the B7-CD28 and TNF families, as well as by attracting regulatory T cells, which inhibit anti-tumor T cell responses (see Wang (2006), "Immune Suppression by Tumor Specific CD4$^+$ Regulatory T cells in Cancer", Semin. Cancer. Biol. 16:73-79; Greenwald, et al. (2005), "The B7 Family Revisited", Ann. Rev. Immunol. 23:515-48; Watts (2005), "TNF/TNFR Family Members in Co-stimulation of T Cell Responses", Ann. Rev. Immunol. 23:23-68; Sadum, et al., (2007) "Immune Signatures of Murine and Human Cancers Reveal Unique Mechanisms of Tumor Escape and New Targets for Cancer Immunotherapy", Clin. Canc. Res. 13(13): 4016-4025). Such tumor expressed co-stimulatory molecules have become attractive cancer biomarkers and may serve as tumor-associated antigens (TAAs). Furthermore, costimulatory pathways have been identified as immunologic checkpoints that attenuate T cell dependent immune responses, both at the level of initiation and effector function within tumor metastases. As engineered cancer vaccines continue to improve, it is becoming clear that such immunologic checkpoints are a major barrier to the vaccines' ability to induce therapeutic anti-tumor responses. In that regard, costimulatory molecules can serve as adjuvants for active (vaccination) and passive (antibody-mediated) cancer immunotherapy, providing strategies to thwart immune tolerance and stimulate the immune system.

Over the past decade, agonists and/or antagonists to various costimulatory proteins have been developed for treating autoimmune diseases, graft rejection, allergy and cancer. For example, CTLA4-Ig (Abatacept, Orencia®) is approved for treatment of RA, mutated CTLA4-Ig (Belatacept, Nulojix®) for prevention of acute kidney transplant rejection and by the anti-CTLA4 antibody (Ipilimumab, Yervoy®), recently approved for the treatment of melanoma. Other costimulation regulators have been approved, such as the anti-PD-1 antibodies of Merck (Keytruda®) and BMS (Opdivo®), have been approved for cancer treatments and are in testing for viral infections as well.

However, while monotherapy with anti-checkpoint inhibitor antibodies have shown promise, a number of studies (Ahmadzadeh et al., Blood 114:1537 (2009), Matsuzaki et al., PNAS 107(17):7875-7880 (2010), Fourcade et al., Cancer Res. 72(4):887-896 (2012) and Gros et al., J.

Clinical Invest. 124(5):2246 (2014)) examining tumor-infiltrating lymphocytes (TILs) have shown that TILs commonly express multiple checkpoint receptors. Moreover, it is likely that TILs that express multiple checkpoints are in fact the most tumor-reactive. In contrast, non-tumor reactive T cells in the periphery are more likely to express a single checkpoint. Checkpoint blockade with monospecific full-length antibodies is likely nondiscriminatory with regards to derepression of tumor-reactive TILs versus autoantigen-reactive single expressing T cells that are assumed to contribute to autoimmune toxicities.

One target of interest is PVRIG. PVRIG, also called Poliovirus Receptor Related Immunoglobulin Domain Containing Protein, Q6DKI7 or C7orf15, is a transmembrane domain protein of 326 amino acids in length, with a signal peptide (spanning from amino acid 1 to 40), an extracellular domain (spanning from amino acid 41 to 171), a transmembrane domain (spanning from amino acid 172 to 190) and a cytoplasmic domain (spanning from amino acid 191 to 326). PVRIG binds to Poliovirus receptor-related 2 protein (PVLR2, also known as nectin-2, CD112 or herpesvirus entry mediator B, (HVEB) a human plasma membrane glycoprotein), the binding partner of PVRIG.

Another target of interest is TIGIT. TIGIT is a coinhibitory receptor that is highly expressed on effector & regulatory (Treg) CD4+ T cells, effector CD8+ T cells, and NK cells. TIGIT has been shown to attenuate immune response by (1) direct signaling, (2) inducing ligand signaling, and (3) competition with and disruption of signaling by the costimulatory receptor CD226 (also known as DNAM-1). TIGIT signaling has been the most well-studied in NK cells, where it has been demonstrated that engagement with its cognate ligand, poliovirus receptor (PVR, also known as CD155) directly suppresses NK cell cytotoxicity through its cytoplasmic ITIM domain. Knockout of the TIGIT gene or antibody blockade of the TIGIT/PVR interaction has shown to enhance NK cell killing in vitro, as well as to exacerbate autoimmune diseases in vivo. In addition to its direct effects on T- and NK cells, TIGIT can induce PVR-mediated signaling in dendritic or tumor cells, leading to the increase in production of anti-inflammatory cytokines such as IL10. In T-cells TIGIT can also inhibit lymphocyte responses by disrupting homodimerization of the costimulatory receptor CD226, and by competing with it for binding to PVR.

TIGIT is highly expressed on lymphocytes, including Tumor Infiltrating Lymphocytes (TILs) and Tregs, that infiltrate different types of tumors. PVR is also broadly expressed in tumors, suggesting that the TIGIT-PVR signaling axis may be a dominant immune escape mechanism for cancer. Notably, TIGIT expression is tightly correlated with the expression of another important coinhibitory receptor, PD1. TIGIT and PD1 are co-expressed on the TILs of numerous human and murine tumors. Unlike TIGIT and CTLA4, PD1 inhibition of T cell responses does not involve competition for ligand binding with a costimulatory receptor.

Accordingly, TIGIT is an attractive target for monoclonal antibody therapy, and in addition in combination with additional antibodies including anti-PVRIG antibodies.

III. BRIEF SUMMARY OF THE INVENTION

Accordingly, in one aspect, the invention provides compositions comprising an antigen binding domain that binds to human TIGIT (SEQ ID NO:97) comprising a variable heavy domain comprising SEQ ID NO:160 and a variable light domain comprising SEQ ID NO:165. Additionally, the antigen binding domain comprises a variable heavy domain comprising SEQ ID NO:150 and a variable light domain comprising SEQ ID NO:155. Additionally, the antigen binding domain comprises a variable heavy domain comprising SEQ ID NO:560 and a variable light domain comprising SEQ ID NO:565.

In a further aspect, the invention provides composition comprising antibodies comprising a heavy chain comprising VH-CH1-hinge-CH2-CH3, wherein said VH comprises SEQ ID NO:160 and a light chain comprising VL-VC, wherein said VL comprising SEQ ID NO:165 and VC is either kappa or lambda. Additionally, the antibody can comprise a heavy chain comprising VH-CH1-hinge-CH2-CH3, wherein the VH comprises SEQ ID NO:150; and a light chain comprising VL-VC, wherein said VL comprising SEQ ID NO:159 and VC is either kappa or lambda. Additionally, the antibody can comprise a heavy chain comprising VH-CH1-hinge-CH2-CH3, wherein the VH comprises SEQ ID NO:560; and a light chain comprising VL-VC, wherein said VL comprising SEQ ID NO:565 and VC is either kappa or lambda.

In some aspects, the sequence of the CH1-hinge-CH2-CH3 is selected from human IgG1, IgG2 and IgG4, and variants thereof. In some aspects, the heavy chain has SEQ ID NO:164 and the light chain has SEQ ID NO:169.

In an additional aspect, the compositions can further comprise a second antibody that binds to a human checkpoint receptor protein, which can be human PD-1 or human PVRIG. The second antibody can comprise an antigen binding domain comprising a variable heavy domain comprising SEQ ID NO:5 and a variable light domain comprising SEQ ID NO:10, or a heavy chain having SEQ ID NO:9 and a light chain having SEQ ID NO:14.

In a further aspect, the invention provides nucleic acid compositions comprising a first nucleic acid encoding a variable heavy domain comprising SEQ ID NO:160 and a second nucleic acid encoding a variable light domain comprising SEQ ID NO:165. Alternatively, the nucleic acid compositions comprise a first nucleic acid encoding a variable heavy domain comprising SEQ ID NO:150 and a second nucleic acid encoding a variable light domain comprising SEQ ID NO:155. Alternatively, the nucleic acid compositions comprise a first nucleic acid encoding a variable heavy domain comprising SEQ ID NO:560 and a second nucleic acid encoding a variable light domain comprising SEQ ID NO:565.

In a further aspect, the invention provides expression vector compositions comprising these nucleic acid compositions are provided as well, such as a first expression vector comprising a first nucleic acid and a second expression vector comprising a second nucleic acid, or alternatively an expression vector that comprises both first and second nucleic acids.

In an additional aspect, the invention provides host cells comprising the expression vector compositions, and methods of making the antibodies comprising culturing the host cells under conditions wherein the antibodies are produced and recovering the antibody.

In a further aspect the invention provides anti-PVRIG antibodies comprising a heavy chain having SEQ ID NO:9 and a light chain having SEQ ID NO:14. The invention further provides antibodies having a heavy chain having SEQ ID NO:19; and a light chain having SEQ ID NO:24.

In an additional aspect, an anti-PVRIG antibody (either CHA.7.518.1.H4(S241P) or CHA.7.538.1.2.H4(S241P) are co-administered with a second antibody that binds to a human checkpoint receptor protein, such as an antibody that binds PD-1.

In a further aspect, an anti-PVRIG antibody (either CHA.7.518.1.H4(S241P) or CHA.7.538.1.2.H4(S241P)) are co-administered with a second antibody that binds to a human checkpoint receptor protein, such as an antibody that binds human TIGIT, such as CPA.9.086 or CPA.9.083 or CHA.9.547.13.

In a further aspect, the invention provides nucleic acid compositions comprising a first nucleic acid encoding the heavy chain of either CHA.7.518.1.H4(S241P) or CHA.7.538.1.2.H4(S241P)) and a second nucleic acid encoding the light chain of either CHA.7.518.1.H4(S241P) or CHA.7.538.1.2.H4(S241P), respectively.

In a further aspect, the invention provides expression vector compositions comprising these nucleic acid compositions are provided as well, such as a first expression vector comprising a first nucleic acid and a second expression vector comprising a second nucleic acid, or alternatively an expression vector that comprises both first and second nucleic acids.

In an additional aspect, the invention provides host cells comprising the expression vector compositions, and methods of making the antibodies comprising culturing the host cells under conditions wherein the antibodies are produced and recovering the antibody.

In a further aspect, the invention provides methods comprising: a) providing a cell population from a tumor sample from a patient; b) staining said population with labeled antibodies that bind: i) TIGIT protein; ii) PVR protein; iii) PD-1 protein; iv) PD-L1 protein; and v) an isotype control; c) running fluorescence activated cell sorting (FACS); d) for each of TIGIT, PVR, PD-1 and PD-L1, determining the percentage of cells in said population that express the protein relative to said isotype control antibody; wherein if the percentage of positive cells is ≥1% for all 4 receptors, e) administering antibodies to TIGIT and PD-1 to said patient.

In an additional aspect, the invention provides methods comprising: a) providing a cell population from a tumor sample from a patient; b) staining said population with labeled antibodies that bind: i) PVRIG protein; PVRL2 protein; PD-1 protein; iv) PD-L1 protein; and v) an isotype control; c) running fluorescence activated cell sorting (FACS); d) for each of PVRIG, PVRL2, PD-1 and PD-L1, determining the percentage of cells in said population that express the protein relative to said isotype control antibody; wherein if the percentage of positive cells is ≥1% for all 4 receptors, e) administering antibodies to PVRIG and PD-1 to said patient.

In a further aspect, the invention provides methods comprising a) providing a cell population from a tumor sample from a patient; b) staining said population with labeled antibodies that bind: i) PVRIG protein; ii) PVRL2 protein; iii) TIGIT protein; iv) PVR protein; and v) an isotype control; c) running fluorescence activated cell sorting (FACS); d) for each of PVRIG, PVRL2, TIGIT and PVR, determining the percentage of cells in said population that express the protein relative to said isotype control antibody; wherein if the percentage of positive cells is ≥1% for all 4 receptors, e) administering antibodies to PVRIG and TIGIT to said patient.

IV. BRIEF DESCRIPTION OF THE DRAWINGS

FIG. 1 depicts the full-length sequence of human PVRIG (showing two different methionine starting points). The signal peptide is underlined, the ECD is double underlined. PVRIG, also called Poliovirus Receptor Related Immunoglobulin Domain Containing Protein, Q6DKI7 or C7orf15, relates to amino acid and nucleic acid sequences shown in RefSeq accession identifier NP_076975, shown in FIG. 1.

FIG. 2 depicts the sequence of the human Poliovirus receptor-related 2 protein (PVLR2, also known as nectin-2, CD112 or herpesvirus entry mediator B, (HVEB)), the binding partner of PVRIG. PVLR2 is a human plasma membrane glycoprotein.

FIGS. 3A and 3B depicts the variable heavy and light chains as well as the vhCDR1, vhCDR2, vhCDR3, vlCDR1, vlCDR2 and vlCDR3 sequences of each of the enumerated CHA antibodies of the invention, CHA.7.518.1.H4(S241P), and CHA.7.538.1.2.H4(S241P).

Figure 21A:
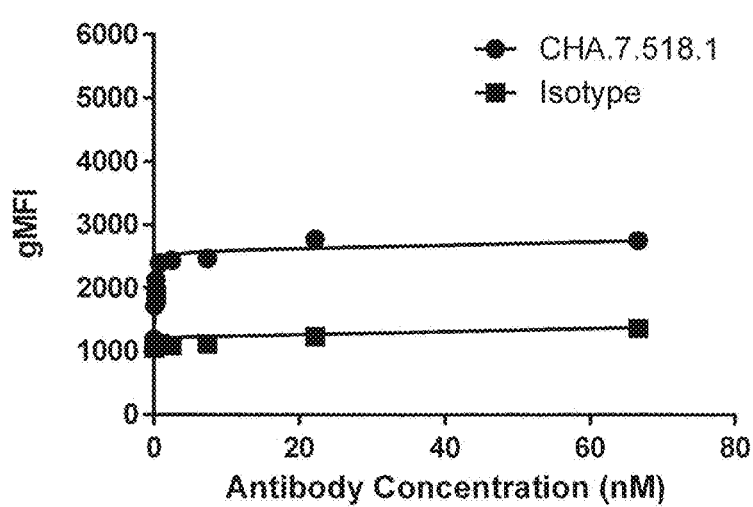

FIGS. 4A and 4B PVRIG antibodies increase T cell proliferation in the MLR. The percentages of CFSE low cells are shown from MLR assays treated with the indicated PVRIG antibodies. Each graph represents one individual CD3 T cell donor. The experiments are described in Example 23 of U.S. Ser. No. 15/048,967, incorporated by reference herein.

FIGS. 5A and 5B PVRIG hybridoma antibody binding characteristics to HEK hPVRIG engineered cell lines, HEK parental cells, and Jurkat cells. HEK OE denotes HEK hPVRIG cells, HEK par denotes HEK parental cells. For Jurkat data, gMFIr indicates the fold difference in geometric MFI of PVRIG antibody staining relative to their controls. Concentration indicates that at which the gMFIr was calculated. No binding indicates antibody does not bind to the tested cell line. Highlighted antibodies are the 'top four' antibodies of interest.

FIGS. 6A and 6B PVRIG hybridoma antibody binding characteristics to primary human PBMC, cyno over-expressing cells, and cyno primary PBMC. Expi cyno OE denotes expi cells transiently transfected with cPVRIG, expi par denotes expi parental cells. gMFIr indicates the fold difference in geometric MFI of PVRIG antibody staining relative to their controls. Concentrations indicate that at which the gMFIr was calculated. Not tested indicates antibodies that were not tested due to an absence of binding to human HEK hPVRIG, expi cPVRIG cells, or not meeting binding requirements to PBMC subsets. Highlighted antibodies are the 'top four' antibodies of interest. The experiments are described in Example 21 of U.S. Ser. No. 15/048,967, incorporated by reference herein.

FIGS. 7A and 7B Summary of blocking capacity of PVRIG antibodies in the FACS-based competition assay. The $IC_{50}$ of inhibition is indicated. No $IC_{50}$ indicates that these antibodies are non-blockers. Highlighted antibodies are the 'top four' antibodies of interest. The experiments are described in Example 21 of U.S. Ser. No. 15/048,967, incorporated by reference herein.

FIGS. 8A and 8B TILs were co-cultured with melanoma cells 624 at 1:1 E:T for 18 hr in the presence of anti-PVRIG Ab (CPA.7.021; 10 ug/ml), anti-TIGIT (10A7 clone; 10 ug/ml) or in combination. Supernatant was collected and tested in Th1 Th2 Th17 cytometric bead array assay to detect secreted cytokines. IFNγ (A) and TNF (B) levels were detected. Treatments were compared by Student's t-test (*P≤0.05, **P≤0.01) of triplicate samples.

FIG. 9A-9F MART-1 or 209 TILs were co-cultured with melanoma cells 624 at 1:1 E:T for 18 hr in the presence of anti-PVRIG Ab (CPA.7.021; 10 ug/ml), anti-DNAM1 (DX11 clone, BD Biosciences Cat. No. 559787; 10 ug/ml) or in combination. Supernatant was collected and tested in Th1 Th2 Th17 cytometric bead array assay to detect secreted cytokines. IFNγ (A,D) and TNF (B,E) levels were detected. TILs were stained for surface expression of CD137 (C,F).

FIGS. 10A and 10B TILs (F4) were co-cultured with melanoma cells 624 at 1:3 E:T for 18 hr in the presence of anti-PVRIG Ab (CPA.7.021; 10 ug/ml), anti-TIGIT (10A7 clone; 10 ug/ml), anti-PD1 (mAb 1B8, Merck; 10 ug/ml) or in combination. Supernatant was collected and tested in Th1 Th2 Th17 cytometric bead array assay to detect secreted cytokines. IFNγ (A) and TNF (B) levels were detected.

FIG. 11A-11E depict four humanized sequences for each of CHA.7.518, CHA.7.524, CHA.7.530, CHA.7.538_1 and CHA.7.538_2. All humanized antibodies comprise the H4(S241P) substitution. Note that the light chain for CHA.7.538_2 is the same as for CHA.7.538_1. The "H1" of each is a "CDR swap" with no changes to the human framework. Subsequent sequences alter framework changes shown in larger bold font. CDR sequences are noted in bold. CDR definitions are AbM from website www.bioinf.org.uk/abs/. Human germline and joining sequences from IMGT® the international ImMunoGeneTics® information system www.imgt.org (founder and director: Marie-Paule Lefranc, Montpellier, France). Residue numbering shown as sequential (seq) or according to Chothia from website www.bioinf.org.uk/abs/ (AbM). "b" notes buried sidechain; "p" notes partially buried; "i" notes sidechain at interface between VH and VL domains. Sequence differences between human and murine germlines noted by asterisk (*). Potential additional mutations in frameworks are noted below sequence. Potential changes in CDR sequences noted below each CDR sequence as noted on the figure (# deamidation substitutions: Q/S/A; these may prevent asparagine (N) deamidation. @ tryptophan oxidation substitutions: Y/F/H; these may prevent tryptophan oxidation; @ methionine oxidation substitutions: L/F/A).

FIG. 12A-12C depicts a collation of the humanized sequences of three CHA antibodies: CHA.7.518, CHA.7.538.1, and CHA.7.538.2.

FIG. 13 depicts schemes for combining the humanized VH and VL CHA antibodies. The "chimVH" and "chimVL" are the mouse variable heavy and light sequences attached to a human IgG constant domain.

FIG. 14 PVRIG hybridoma antibody binding characteristics to primary human PBMC, cyno over-expressing cells, and cyno primary PBMC. Expi cyno OE denotes expi cells transiently transfected with cPVRIG, expi par denotes expi parental cells. gMFIr indicates the fold difference in geometric MFI of PVRIG antibody staining relative to their controls. Concentrations indicate that at which the gMFIr was calculated. Not tested indicates antibodies that were not tested due to an absence of binding to human HEK hPVRIG, expi cPVRIG cells, or not meeting binding requirements to PBMC subsets. Highlighted antibodies are four antibodies for which humanization was done (See FIG. 24). The experiments are described in Example 21 of U.S. Ser. No. 15/048,967, incorporated by reference herein.

FIG. 15. Summary of blocking capacity of PVRIG antibodies in the FACS-based competition assay. The IC50 of inhibition is indicated. No IC50 indicates that these antibodies are non-blockers. Highlighted antibodies are four antibodies for which humanization was done (See FIG. 24).

FIG. 16. Summary of the activity of select PVRIG antibodies in NK cell cytotoxicity assays against Reh and MOLM-13 cells. Fold change in cytotoxicity relative to control was calculated by dividing the absolute level of killing (%) in the condition with PVRIG antibody, by the absolute level of killing (%) with control antibody. Fold change is calculated from the 5:1 effector to target ratio.

FIG. 17. Sequence alignment of PVRIG orthologs. Aligned sequences of the human, cynomolgus, marmoset, and rhesus PVRIG extra-cellular domain. The differences between human and cynomolgus are highlighted in yellow.

FIG. 18A-18F. Binding of anti-human PVRIG antibodies to cyno, human, cyno/human hybrid PVRIG variants. Binding of antibodies to wild type cyno PVRIG (●), H61R cyno PVRIG (■), P67S cyno PVRIG (▲), L95R/T97I cyno PVRIG (▼), and wild type human PVRIG (♦) are shown. The ELISA signals are plotted as a function of antibody concentration.

FIG. 19. Correlation of epitope group and cyno cross-reactivity of anti-human PVRIG antibodies.

FIGS. 20A and 20B (A) Specificity of CHA.7.518.1.H4 (S241P) towards HEK cells engineered to overexpress PVRIG and HEK parental cells. Data shows absolute geometric MFI (gMFI) measurements as a function of increasing antibody concentration. (B) Specificity of CHA.7.538.1.2.H4(S241P) towards HEK cells engineered to overexpress PVRIG and HEK parental cells. Data shows absolute geometric MFI (gMFI) measurements as a function of increasing antibody concentration.

Figure 21B:
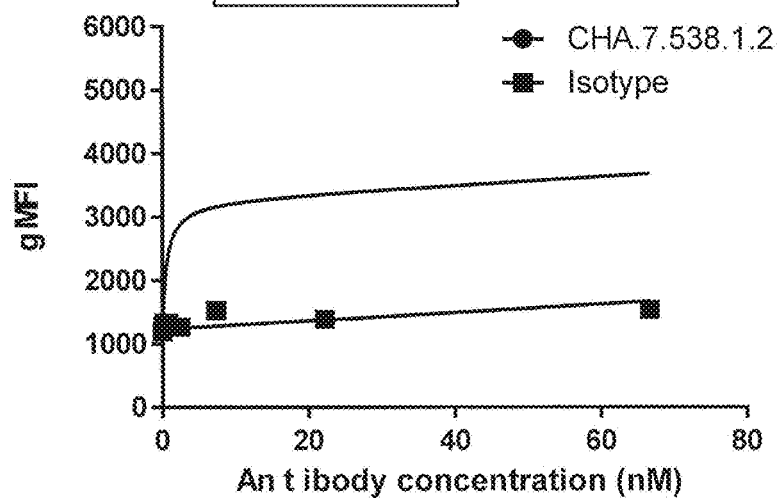

FIGS. 21A and 21B illustrates the ability of CHA.7.518.1.H4(S241P) (A) and CHA.7.538.1.2.H4 (S241P) (B) to bind Jurkat cells that endogenously express PVRIG confirmed by RNA expression. (A) Binding of CHA.7.518.1.H4(S241P) to Jurkat cells. Data shows absolute geometric MFI (gMFI) measurements as a function of increasing antibody concentration. Isotype staining is shown as a negative control. (B) Binding of CHA.7.538.1.2.H4 (S241P) to Jurkat cells. Data shows absolute geometric MFI (gMFI) measurements as a function of increasing antibody concentration. Isotype staining is shown as a negative control. Both antibodies are able to bind Jurkat cells with a comparable affinity to HEK hPVRIG cells.

FIG. 22 illustrates the ability of CHA.7.518.1.H4(S241P) and CHA.7.538.1.2.H4(S241P) to bind CD8 T cells that were expanded by exposure to CMV peptide (494-503, NLVPMVATV) and endogenously express PVRIG confirmed by RNA expression. Binding of CHA.7.518.1.H4 (S241P) and CHA.7.538.1.2.H4(S241P) to CMV peptide-expanded CD8 T cells. Data shows absolute geometric MFI (gMFI) measurements as a function of increasing antibody concentration. Isotype staining is shown as a negative control.

FIGS. 23A and 23B. (A) Specificity of CHA.7.518.1.H4 (S241P) towards expi cells engineered to overexpress cynomolgus PVRIG and expi parental cells. Data shows absolute geometric MFI (gMFI) measurements as a function of increasing antibody concentration. Specificity of CHA.7.538.1.2.H4(S241P) towards expi cells engineered to overexpress cynomolgus PVRIG and expi parental cells. Data shows absolute geometric MFI (gMFI) measurements as a function of increasing antibody concentration.

FIGS. 24A and 24B. (A) Blocking of PVRIG Fc to HEK cells by CHA.7.518.1.H4(S241P) and CHA.7.538.1.2.H4 (S241P). Data shows the percentage of PVRIG Fc binding to HEK cells as a function of increasing antibody concentration relative to maximum PVRIG Fc-induced signal and secondary only background. (B) Effect of CHA.7.544 on the binding of PVRIG Fc to HEK cells. Data shows the absolute gMFI derived from PVRIG Fc binding to HEK cells in the presence of escalating concentrations of CHA.7.544. The amount of PVRIG Fc binding was detected by an anti-mouse Fc secondary conjugated to Alexa 647.

Figure 25A:
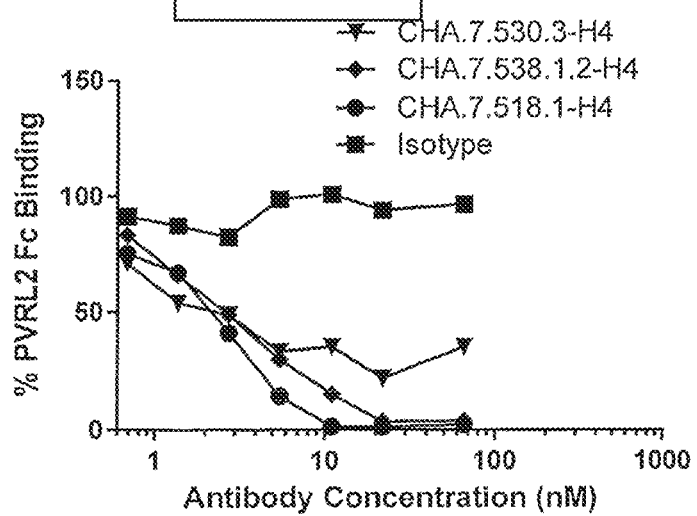
Figure 25B:
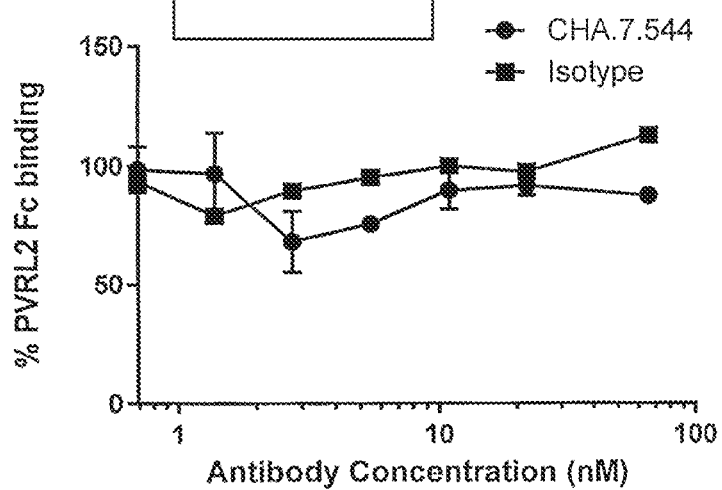

FIGS. 25A and 25B. (A) Blocking of PVRL2 Fc to HEK hPVRIG cells by CHA.7.518.1.H4(S241P), CHA.7.538.1.2.H4(S241P), and CHA.7.530.3. Data shows the percentage of PVRL2 Fc binding to HEK hPVRIG cells as a function of increasing antibody concentration relative to maximum PVRL2 Fc-induced signal and secondary only background. (B) Effect of CHA.7.544 on PVRL2 Fc binding to HEK hPVRIG cells. Data shows the percentage of PVRL2 Fc binding to HEK hPVRIG cells as a function of increasing antibody concentration relative to maximum PVRL2 Fc-induced signal and secondary only background.

FIG. 26. Shows the percentage of Alexa 647 conjugated CHA.7.518.1.H4(S241P) and CHA.7.538.1.2.H4(S241P) binding relative to their maximum signal upon pre-incubation of Jurkat cells with unconjugated CHA.7.518.1.H4 (S241P), CHA.7.538.1.2.H4(S241P) and an isotype control.

Figure 27A:
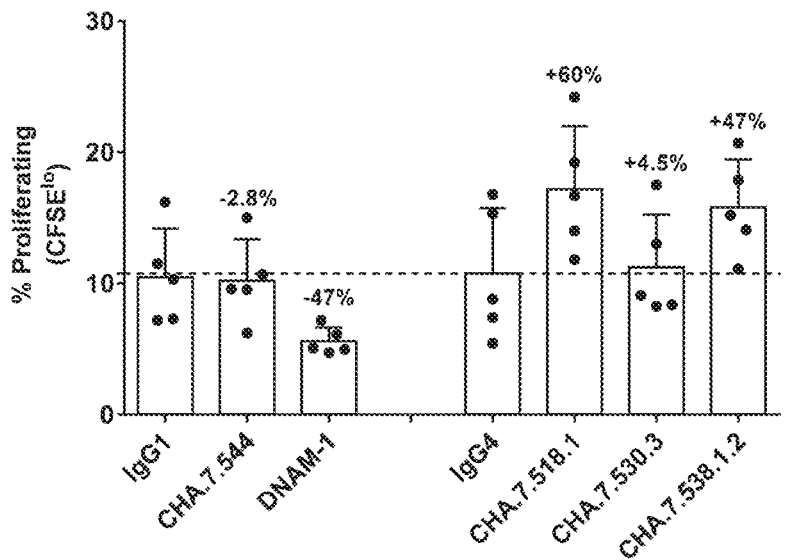
Figure 27B:
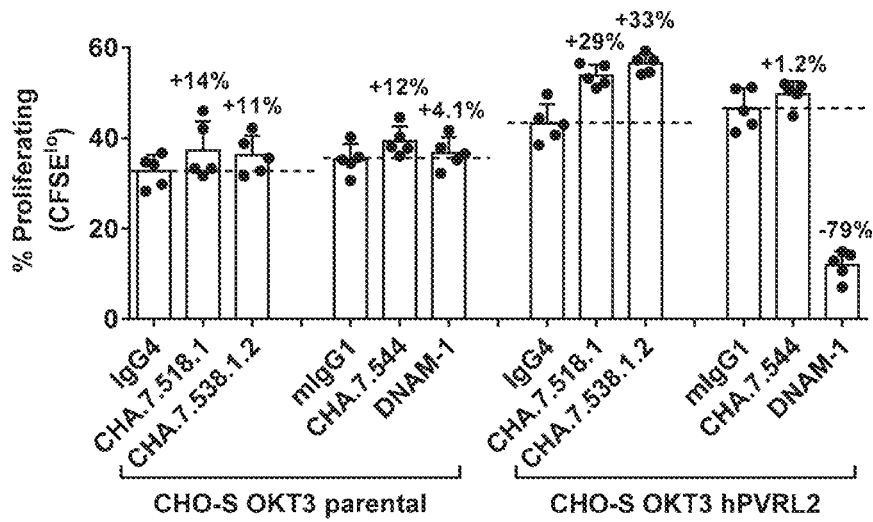

FIGS. 27A and 27B A) Humanized PVRIG antibodies, CHA.7.518.1.H4(S241P) and CHA.7.538.1.2.H4(S241P), increase CD4+ T cell proliferation. Representative data (n≥2) shows the percentage of CFSE low, proliferating CD4+ T cells (mean plus standard deviation) from a single human CD4+ T cell donor when co-cultured with the CHO-S OKT3 hPVRL2 cells in the presence of an anti-DNAM-1 antibody or different anti-PVRIG antibodies or IgG isotype controls. The dashed line indicates the baseline percentage of CFSE low, CD4+ T cells proliferating after treatment with the human IgG4 isotype control antibody. The numbers refer to the percent increase or decrease in proliferation of the anti-PVRIG or anti-DNAM-1 antibody treatments, respectively, compared to the relevant isotype control antibodies (B) Humanized PVRIG antibodies, CHA.7.518.1.H4(S241P) and CHA.7.538.1.2.H4(S241P), increase CD4+ T cell proliferation in an hPVRL2-dependent manner. Representative data (n≥2) shows the percentage of CFSE low, proliferating CD4+ T cells (mean plus standard deviation) from a single human CD4+ T cell donor in response to co-culture with the CHO-S OKT3 parental, or CHO-S OKT3 hPVRL2 cells in the presence of an anti-DNAM-1 antibody or different anti-PVRIG antibodies or IgG isotype controls. The dashed line indicates the baseline percentage of CFSE low CD4+ T cells proliferating after treatment with either the human IgG4 or the mouse IgG1 isotype antibodies. The numbers refer to the percent increase or decrease in proliferation of the anti-PVRIG or anti-DNAM-1 antibody treatments, respectively, compared to the relevant isotype control antibodies.

FIG. 28A-28C. (A) Humanized PVRIG antibodies, CHA.7.518.1.H4(S241P) and CHA.7.538.1.2.H4(S241P), increase CD8+ T cell proliferation. Representative data (n≥2) shows the percentage of CFSE low, proliferating CD8+ T cells (mean plus standard deviation) from a single human CD8+ T cell donor (Donor 232) when co-cultured with the CHO-S OKT3 hPVRL2 cells in the presence of an anti-DNAM-1 antibody or different anti-PVRIG antibodies or IgG isotype controls. The dashed line indicates the baseline percentage of CFSE low, CD8+ T cells proliferating after treatment with the mouse IgG1 or human IgG4 isotype antibodies. The numbers refer to the percent increase or decrease in proliferation of the anti-PVRIG or anti-DNAM-1 antibody treatments, respectively, compared to the relevant isotype control antibodies. (B) Humanized PVRIG antibodies, CHA.7.518.1.H4(S241P) and CHA.7.538.1.2.H4(S241P), increase CD8+ T cell proliferation. Representative data (n≥2) shows the percentage of CFSE low, proliferating CD8+ T cells (mean plus standard deviation) from a single human CD8+ T cell donor (Donor 234) when co-cultured with the CHO-S OKT3 hPVRL2 cells in the presence of an anti-DNAM-1 antibody or different anti-PVRIG antibodies or IgG isotype controls. The dashed line indicates the baseline percentage of CFSE low, CD8+ T cells proliferating after treatment with the mouse IgG1 or human IgG4 isotype antibodies. The numbers refer to the percent increase or decrease in proliferation of the anti-PVRIG or anti-DNAM-1 antibody treatments, respectively, compared to the relevant isotype control antibodies. (C) Humanized PVRIG antibodies, CHA.7.518.1.H4 (S241P) and CHA.7.538.1.2.H4(S241P), increase IFNγ secretion from CD8+ T cells. Representative data (n≥2) shows the pg/ml of IFNγ produced (mean plus standard deviation) by three different human CD8+ T cell donors (Donors 231, 232, and 234) when co-cultured with the CHO-S OKT3 hPVRL2 cells in the presence of an anti-DNAM-1 antibody or different anti-PVRIG antibodies or IgG isotype controls. The dashed line indicates the baseline IFNγ production following treatment with the human IgG4 isotype antibody. The numbers refer to the percent increase in IFNγ secretion of the anti-PVRIG antibody treatments compared to the IgG4 isotype control.

Figure 29:
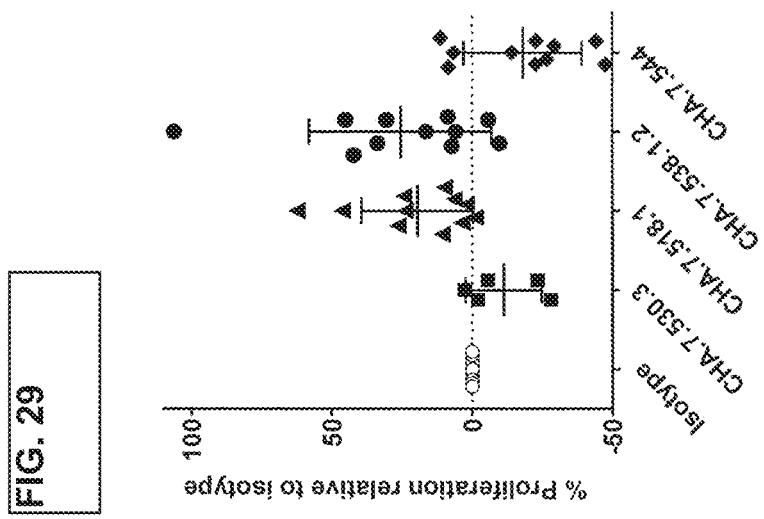

FIG. 29. Humanized PVRIG antibodies, CHA.7.518.1.H4 (S241P) and CHA.7.538.1.2.H4(S241P), consistently increase CD4+ T cell proliferation across multiple donors, while CHA.7.530.3 and CHA.7.544 do not. The percent proliferation relative to the isotype control was calculated by dividing the percentage of CFSE low, CD4+ T cells after PVRIG antibody treatment over the isotype antibody treatment for each donor. The percent proliferation for the isotype antibody treatment was set at zero. Each symbol in the graph represents a different donor.

FIG. 30A-30D. (A) Dose-dependent effect of the humanized PVRIG antibodies, CHA.7.518.1.H4(S241P) and CHA.7.538.1.2.H4(S241P), on CD4+ T cell proliferation. Representative data (n≥2) with 2 different human donors shows the mean percentage of proliferating CD4+ T cells following a dose titration of 66 nM to 0.726 nM with either the human IgG4 isotype, CHA.7.518.1.H4(S241P), or CHA.7.538.1.2.H4(S241P) antibodies. The estimated EC50 is within the single digit nM range. (B) Dose-dependent effect of the humanized PVRIG antibodies, CHA.7.518.1.H4(S241P) and CHA.7.538.1.2.H4(S241P), on CD8+ T cell proliferation. Representative data (n≥2) with 2 different human donors shows the mean percentage of proliferating CD8+ T cells following a dose titration of 66 nM to 0.264 nM with either the human IgG4 isotype, CHA.7.518.1.H4(S241P), CHA.7.38.1.2, or CHA.7.544 antibodies. The estimated EC50 is within the single digit nM range.

Figure 31B:
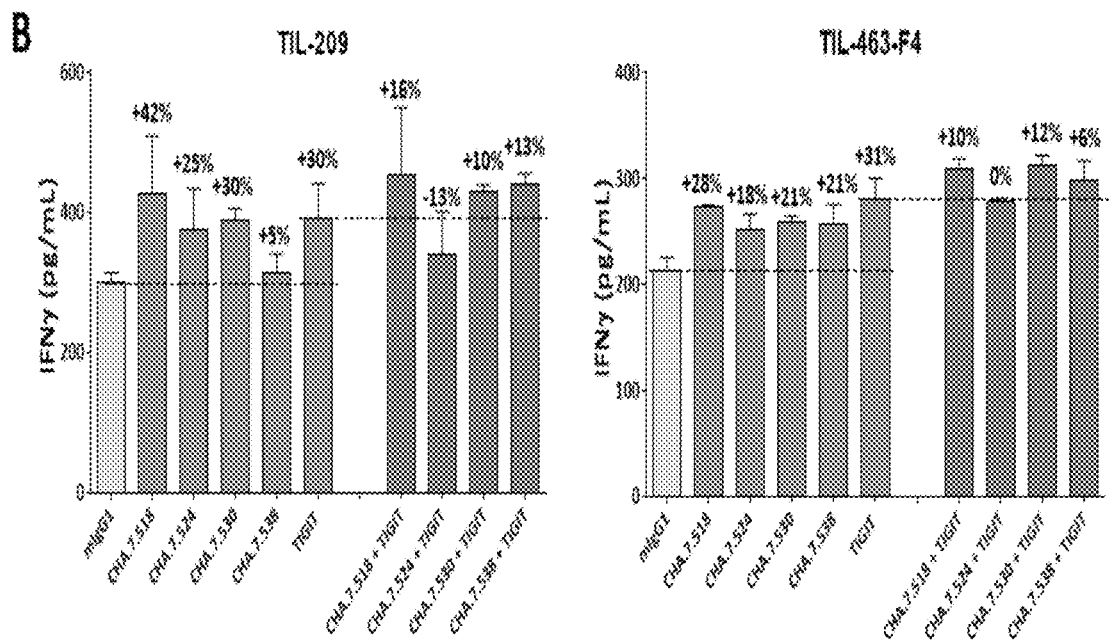
Figure 31C:
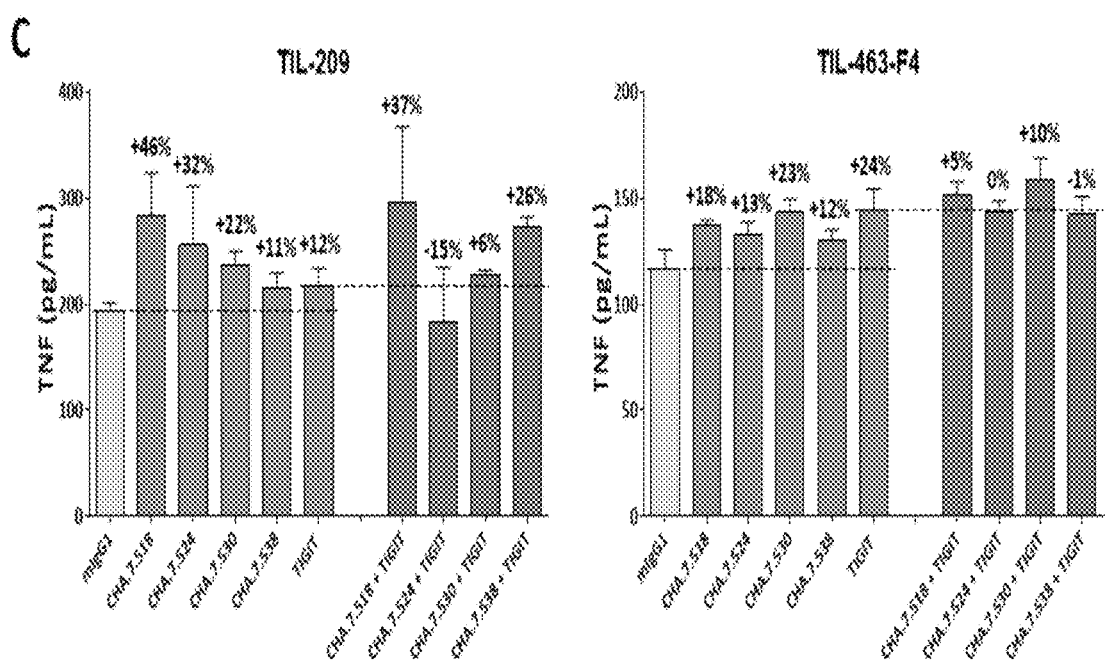
Figure 32A:
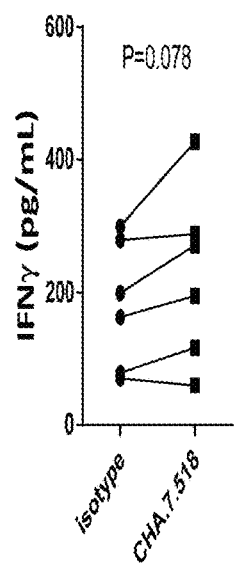
Figure 32B:
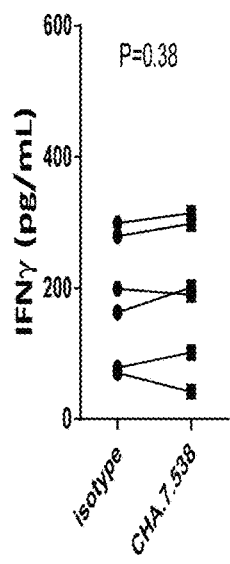
Figure 32C:
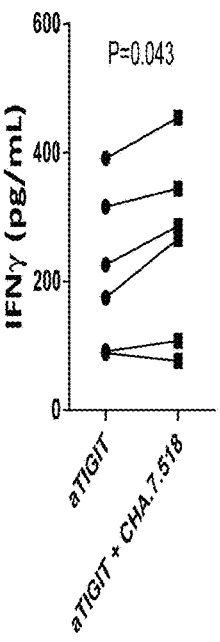
Figure 32D:
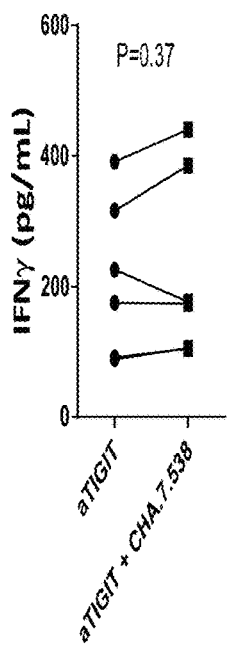
Figure 32E:
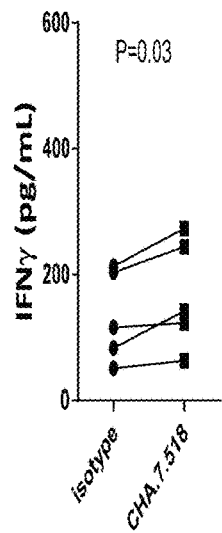
Figure 32F:
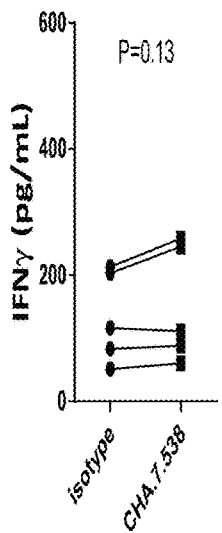
Figure 32G:
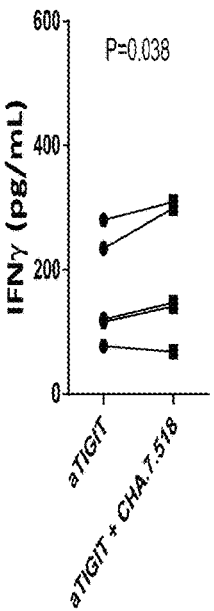
Figure 32H:
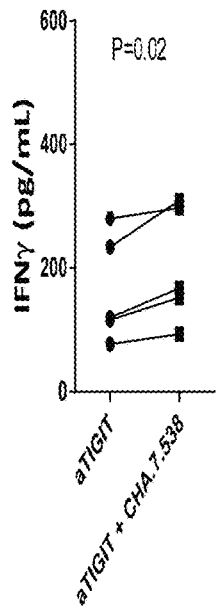

FIG. 31A-31C. (A) Flow cytometry analysis of TIGIT and PVRIG expression on TILs and PVR, PVRL2 expression on 624 melanoma cell line. Values represent Mean fluorescent intensity (MFI) ratio vs isotype control. (B-C) Representative experiment showing IFNγ (B) and TNF (C) secretion by TILs upon co-cultured with melanoma cells 624 at 1:3 E:T for 18 hr in the presence of isotype control, anti-TIGIT (30 μg/ml) or anti-PVRIG Abs (10 ug/ml) as mono treatment (blue histograms) or in combination with anti-TIGIT (green histograms). Percentage of Ab mono treatment effect was compared to isotype control treatment mIgG1 and the percentage of Ab combo-treatment effect was compared to anti-TIGIT mono-treatment.

FIG. 32A-32H. TILs (209-gp100/463-F4-gp100) were co-cultured with melanoma cells 624 in 1:3 E:T for 18 hr in the presence of anti PVRIG Abs CHA.7.518.1.H4(S241P) or CHA.7.538 with or without anti-TIGIT (aTIGIT) combo and tested for cytokine secretion. Percentage of Ab treatment effect was compared to isotype control treatment and the mean of 5 experiments (F4) or 6 experiments (209) were plotted. Paired, two tailed T test was calculated for each treatment compared to isotype or in combos—compared to anti-TIGIT alone, p values are indicated.

Figure 33A:
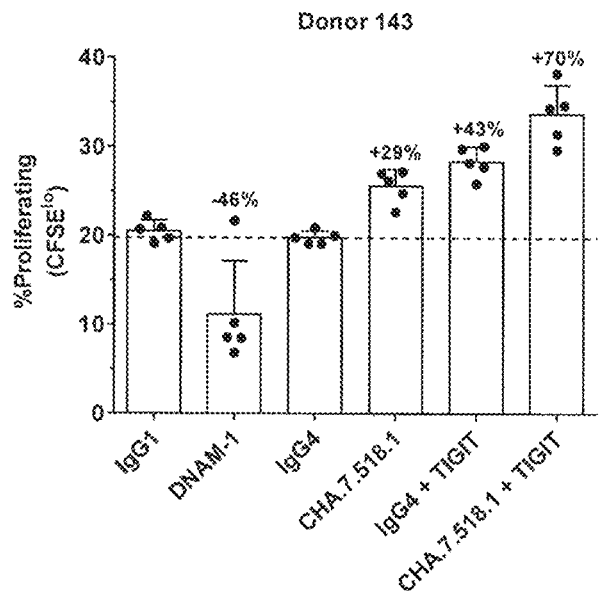
Figure 33B:
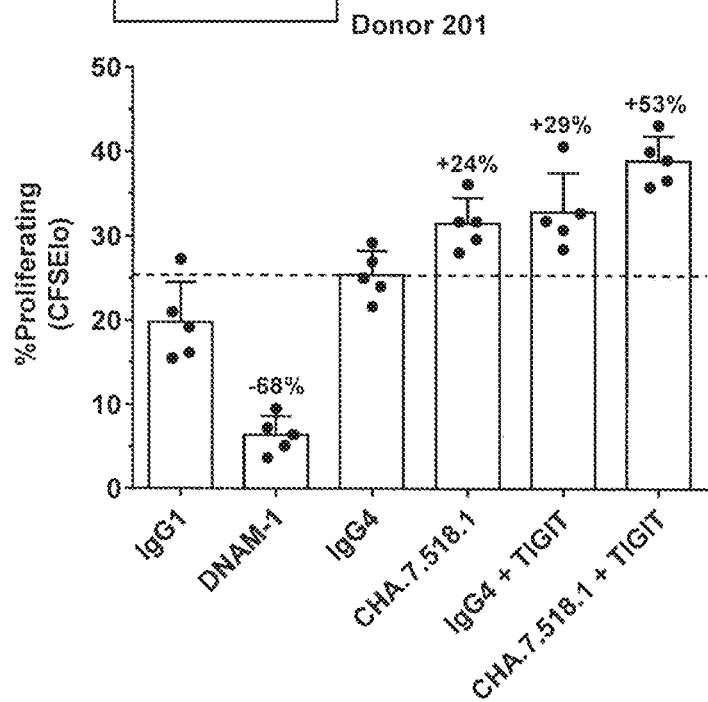

FIGS. 33A and 33B. (A) Humanized PVRIG antibody, CHA.7.518.1.H4(S241P), and an anti-TIGIT antibody increase CD4+ T cell proliferation compared to single antibody treatments. Representative data (n≥2) shows the percentage of CFSE low, proliferating CD4+ T cells (mean plus standard deviation) from a single human CD3+ T cell donor (Donor 143) when co-cultured with the CHO-S OKT3 hPVRL2 cells. The dashed line indicates the baseline percentage of CFSE low, CD4+ T cells proliferating after treatment with the human IgG4 isotype control antibody. (B) Humanized PVRIG antibody, CHA.7.518.1.H4(S241P), and the anti-TIGIT antibody increase CD4+ T cell proliferation compared to single antibody treatments. Representative data (n≥2) shows the percentage of CFSE low, proliferating CD4+ T cells (mean plus standard deviation) from a single human CD4+ T cell donor (Donor 201) when co-cultured with the CHO-S OKT3 hPVRL2 cells. The dashed line indicates the baseline percentage of CFSE low, CD4+ T cells proliferating after treatment with the human IgG4 isotype control antibody. The numbers refer to the percent increase or decrease in proliferation of the anti-PVRIG or anti-DNAM-1 antibody treatments, respectively, compared to the relevant isotype control antibodies.

Figure 34A:
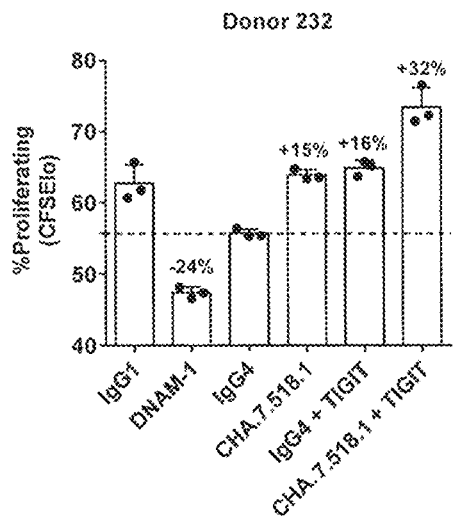
Figure 34B:
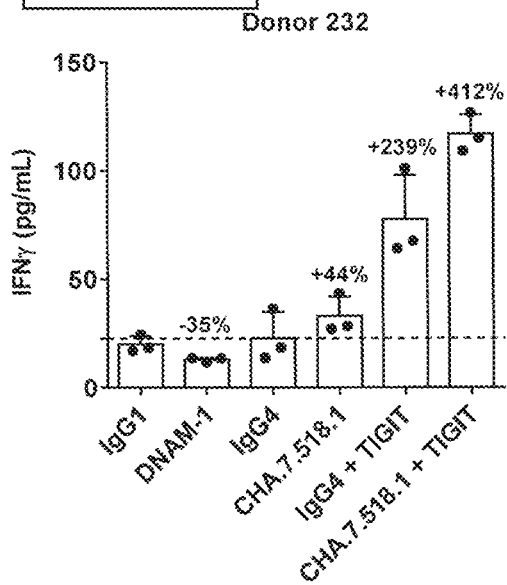

FIGS. 34A and 34B. (A): The combination of the humanized PVRIG antibody, CHA.7.518.1.H4(S241P), and the anti-TIGIT antibody increases CD8+ T cell proliferation. Representative data (n≥2) shows the percentage of CFSE low, proliferating CD8+ T cells (mean plus standard deviation) from a representative human CD8+ T cell donor (Donor 232) when co-cultured with the CHO-S OKT3 hPVRL2 cells. The dashed line indicates the baseline percentage of CFSE low, CD8+ T cells proliferating after treatment with the human IgG4 isotype antibody. The numbers refer to the percent increase or decrease in proliferation of the anti-PVRIG or anti-DNAM-1 antibody treatments, respectively, compared to the relevant isotype control antibodies. (B) The combination of the humanized PVRIG antibody, CHA.7.518.1.H4(S241P), and the anti-TIGIT antibody increases IFNγ secretion from CD8+ T cells. Representative data (n≥2) shows the pg/ml of IFNγ produced (mean plus standard deviation) by a representative human CD8+ T cell donor (Donor 232) when co-cultured with the CHO-S OKT3 hPVRL2 cells. The dashed line indicates the baseline IFNγ production following treatment with the human IgG4 isotype antibody. The numbers refer to the percent increase or decrease in IFNγ secretion of the anti-PVRIG or anti-DNAM-1 antibody treatments, respectively, compared to the relevant isotype control antibodies.

Figure 35:
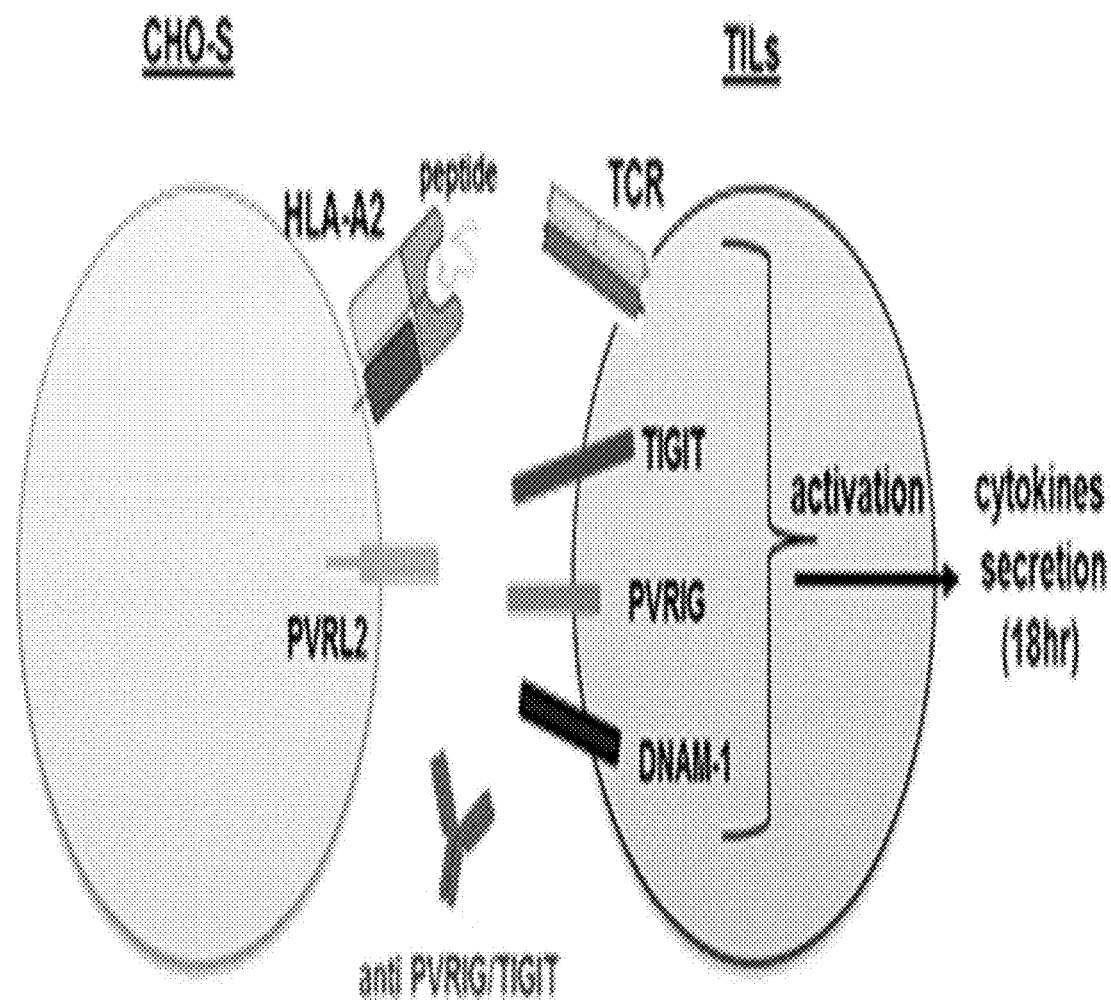

FIG. 35 depicts the design of the experimental system of Example 2(3).

Figure 36:
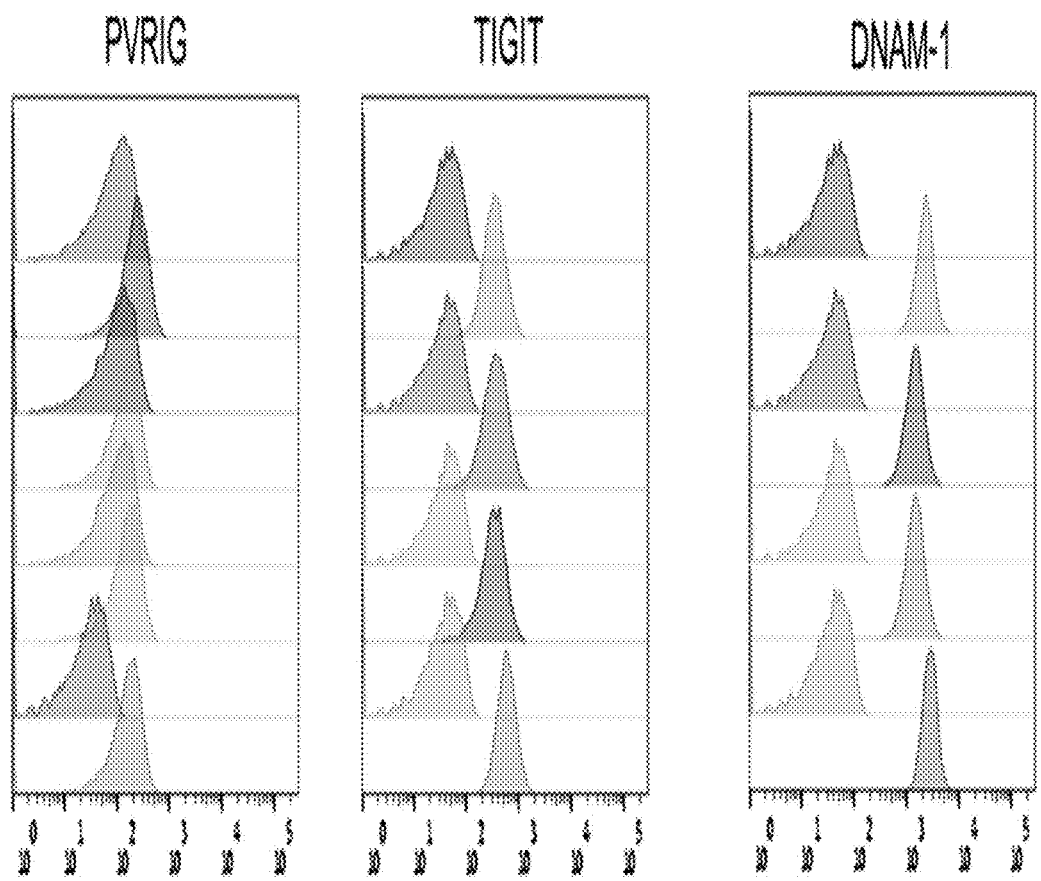

FIG. 36A-36C. shows a histogram depicting levels of PVRIG (using Anti-Human PVRIG CHA.7.538.AF647), TIGIT (using Anti-Human TIGIT Cat. 17-9500-41 eBioscience) and DNAM-1 (using Anti-human CD226-APC Cat. 338312 biolegend) expression in TILs. Fold of expression is compared to isotype (Iso) control.

Figure 37:
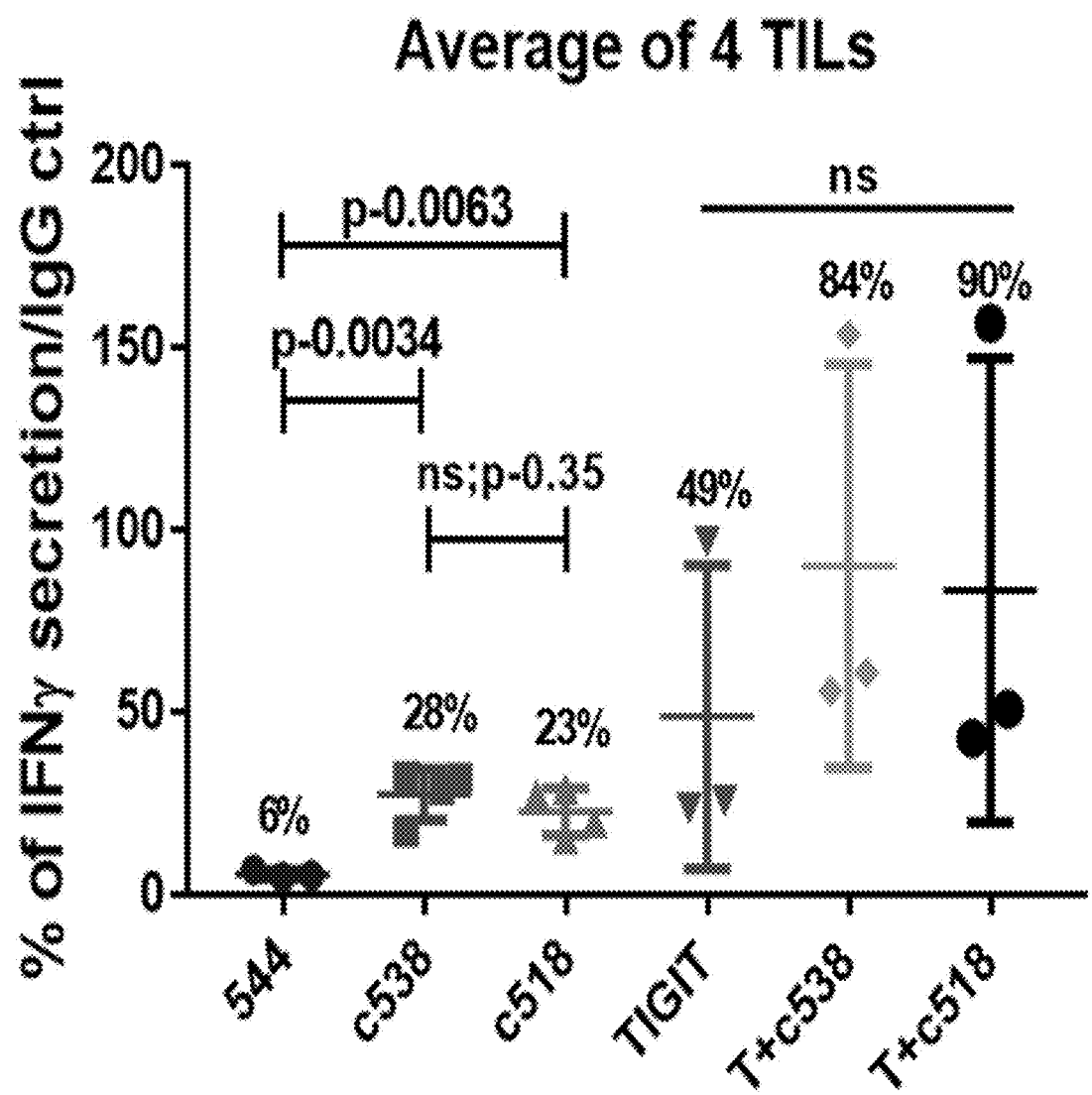

FIG. 37. Summarized plot of the effect of anti PVRIG antibodies on the secretion of IFNγ from TILs. TILs were co-cultured with CHO-S HLA-A2/B2M cells over-expressing PVRL2 in E:T ratio of 1:3 for 18 hr in the presence of anti PVRIG antibodies (c518, c538 and 544) or with anti TIGIT antibody. Each dot represents an average of data of IFNγ secretion from the same TIL from different experiments. The percentage indicated is the different between each antibody treatment compared to isotype control. Paired, two tailed T-test was calculated for each treatment compared to 544 or in combos, compared to anti TIGIT alone, p values are indicated. Number of experiments preformed per each TILs; 209(N=3), F4 (N=2), F5(N=3) and MART1(N=2).

Figure 38A:
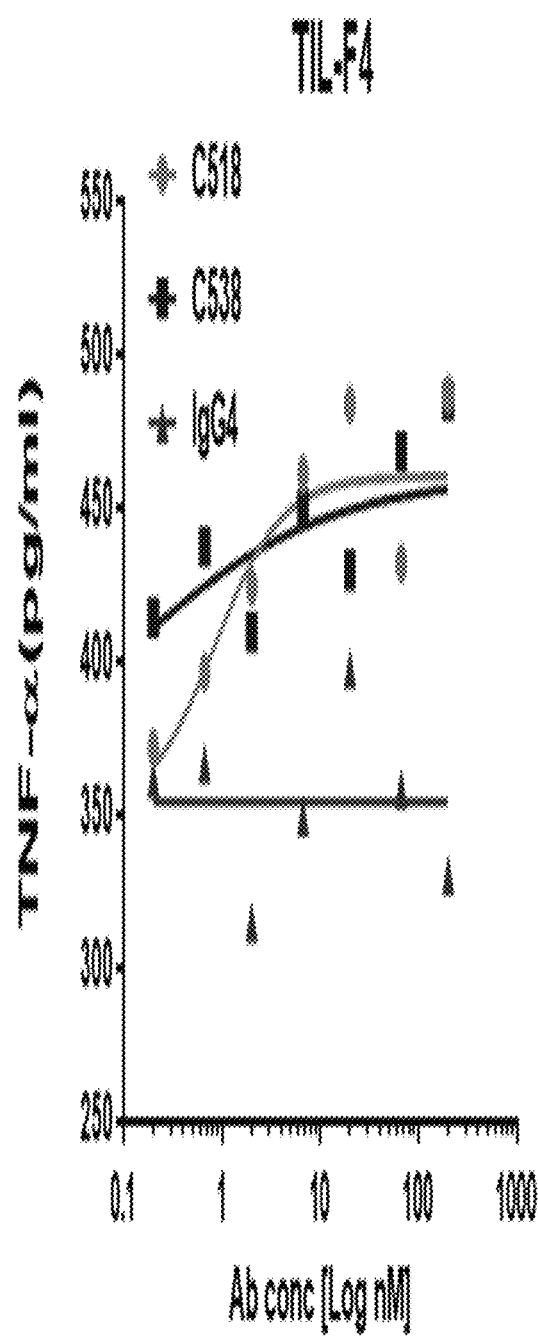
Figure 38B:
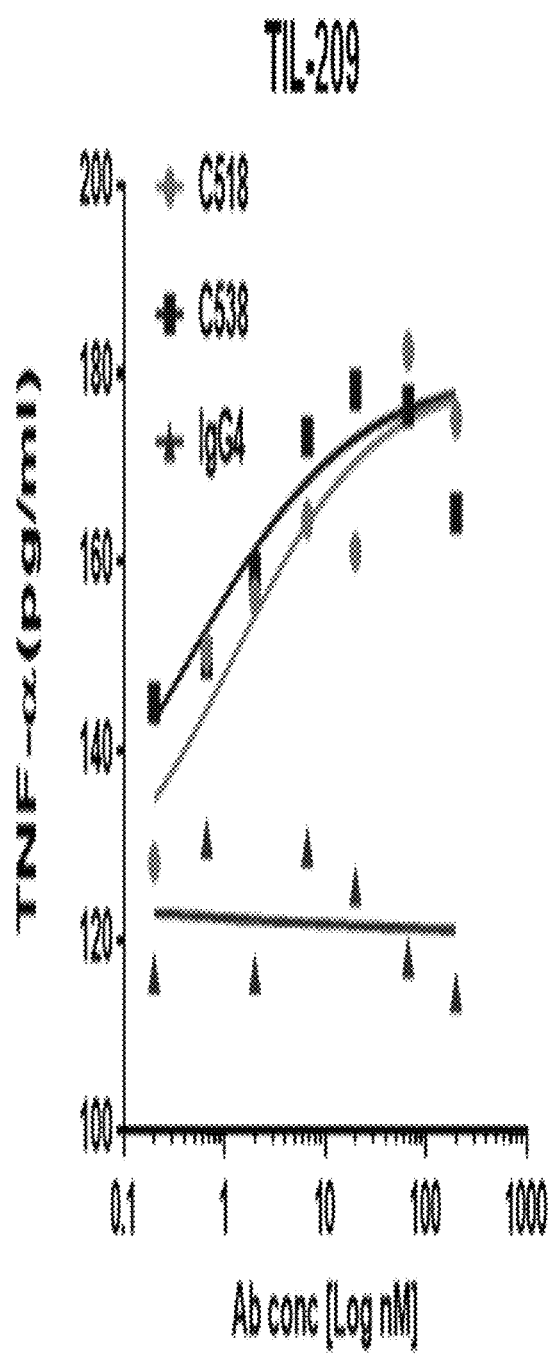

FIGS. 38A and 38B. Summarized plot of the effect of c518 and c538 dose response on the secretion of TNF-α from TILs. TILs were co-cultured with CHO-S HLA-A2/B2M cells over-expressing PVRL2 in effector-to-target ratio of 1:3 for 18 hr in the presence of anti PVRIG antibodies (c518, c538 or isotype control) as described in Example 2(3).

FIG. 39A-39C. TILs were co-cultured with CHO-S HLA-A2/B2M target cells over-expressing PVRL2 in E:T ration of 1:3 for 18 hr in the presence of anti PVRIG antibodies (c518, c538 and 544) or with anti TIGIT antibody. The percentage indicated in the above tables is the difference in the effect of cytokine secretion from TILs of each antibody treatment compared to its isotype control. The first experiment is represented in Figure A and B, and the second experiment in Figure C.

FIGS. 40A and 40B. CHO-S OKT3 co-culture assay design. CFSE labeled CD3+ T cells were co-cultured with CHO-S-OKT3-PVRL2 or mock transfected cells for 5 d. The effect anti-PVRIG Abs on T cell proliferation and cytokine secretion was analyzed.

FIGS. 41A and 41B. Effect of anti-PVRIG antibodies on IFNγ secretion upon CHO-OKT3 PVRL2 cells in responder vs. non-responder donor. CD3+ cells from 2 different donors were co-cultured with CHO-S-PVRL2 cells in 5:1 E:T for 5 d in the presence of anti PVRIG Abs and tested for cytokine secretion and T cells proliferation. (A) 'responder donor' in which we observed an effect to anti PVRIG Abs. (B) 'non-responder donor' in which we do not observed effects to Abs treatment.

FIGS. 42A and 42B. Effect of anti-PVRIG antibodies on CD4 and CD8 proliferation from responder donor. CFSE labeled CD3+ T cells were co-cultured with CHO-S-PVRL2 cells in 5:1 E:T for 5 d in the presence of anti PVRIG Abs or anti-TIGIT Abs. The effect on T cells proliferation gating on CD4 or CD8 was evaluated by flow cytometry. Percentage of proliferating cells (CFSE low) (A) or total cells number (B) of CD4+CFSElow or CD8+CFSE low are presented.

Figure 43C:
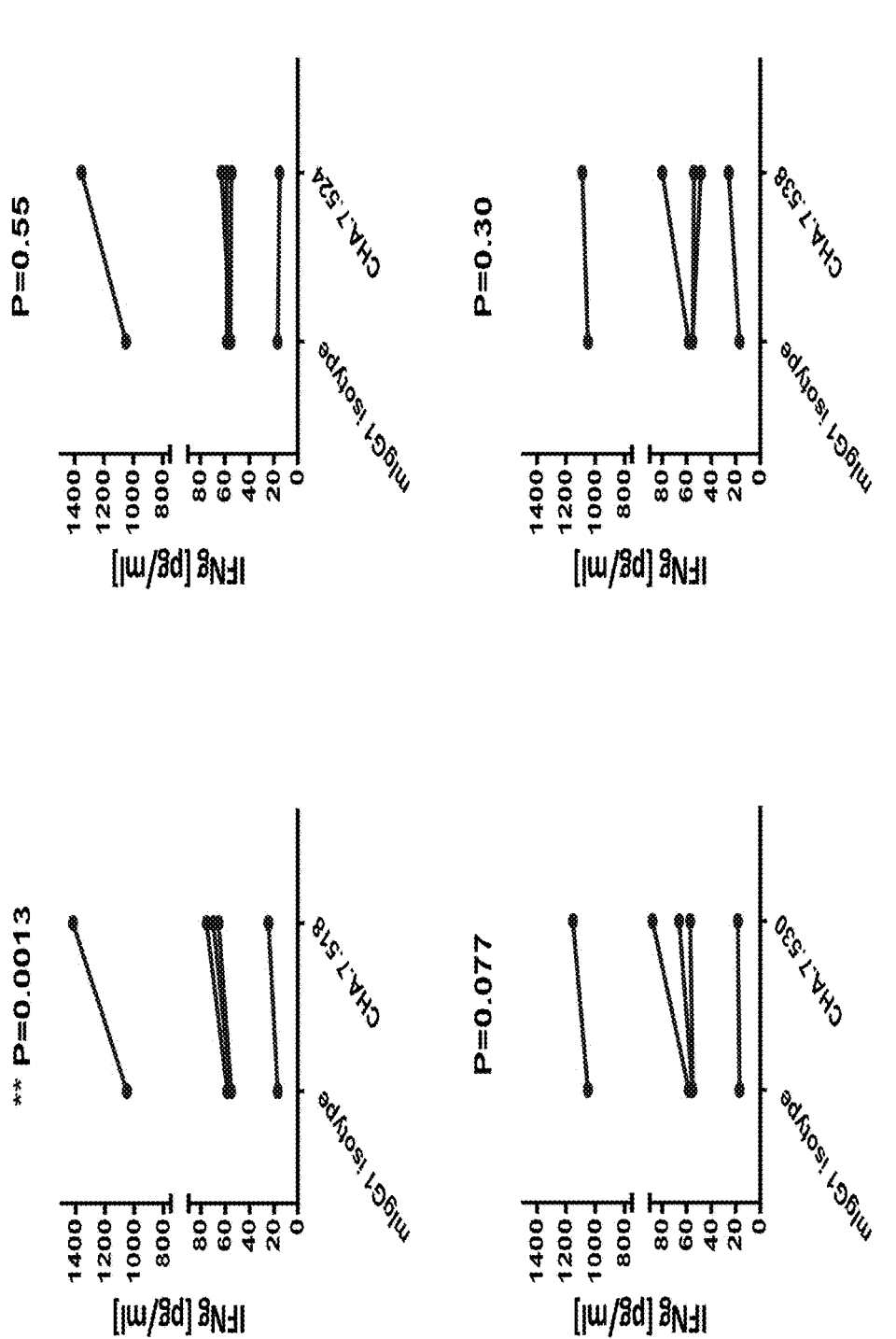

FIG. 43A-43C. Shows the effect of anti-PVRIG antibodies on IFNγ secretion or CD8 proliferation from responder donor. CD3+ cells were co-cultured with CHO-S-PVRL2 cells in 5:1 E:T for 5 d in the presence of anti PVRIG Abs and tested for (A) cytokine secretion and (B) T cells proliferation. Percentage of Ab treatment effect was compared to isotype control treatment and the mean of 5 'responders' donors (responders) is presented. (C) IFNγ secretion levels from the same 5 donors upon co-culture with CHOS-OKT3 PVRL2 as described in section A and B upon treatment with isotype vs. anti-PVRIG Abs. p value represent ratio paired T test.

FIG. 44 is a summary table of Abs treatment effect across donors tested (n=10). Percentages indicated represent the effect of Ab treatment on a specific readout (indicated in columns titles) as compared to the relevant isotype control. 'responder' donors (donors #3, 72,226,345 and ES_001) considered as 'responder' which some anti-PVRIG Abs (mainly CHA.7.518) enhanced IFNγ or proliferation vs. isotype controls.

FIG. 45A-45C depict the results of experiments with several antibodies. The affinities (nM) are shown in A, with the HEK hPVRIG cells being HEK cells transformed with hPVRIG as discussed herein and Jurkat cells expressing endogeneous hPVRIG. (B) depicts the gMFI using 4 different antibodies against Donor 1 primary CD8 T cells and (C) being Donor 2 primary CD8 T cells.

FIGS. 46A and 46B depict interactions of TIGIT with CHO cells. (A) Human TIGIT Fc protein binds to CHO cells. Graded concentrations of human TIGIT Fc and synagis IgG1 control were assessed for their ability to bind to CHO cells in a FACS-based binding assay. (B) Human PVR is expressed on activated CD4 T cells. CD4 T cells were co-cultured with CHO cells expressing the scFv of the OKT3 antibody and activated for 5 days. On day 5, CD4 T cells were analysed for expression of PVR and dilution of CFSE.

Figure 47A:
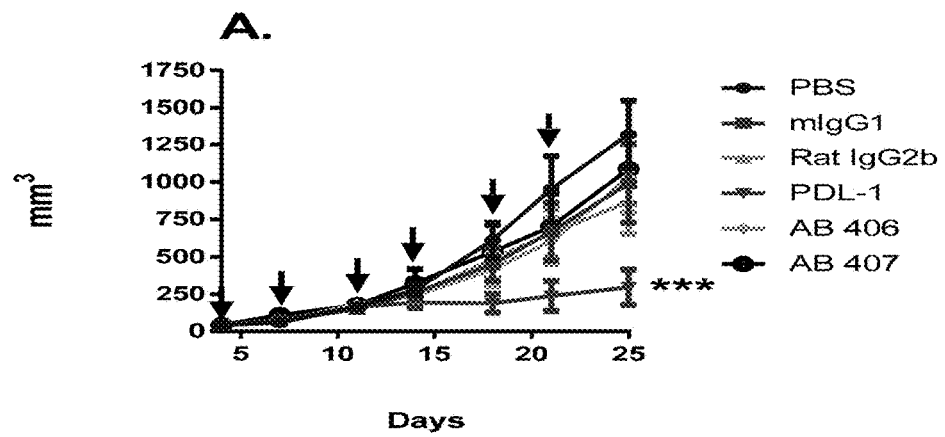
Figure 47B:
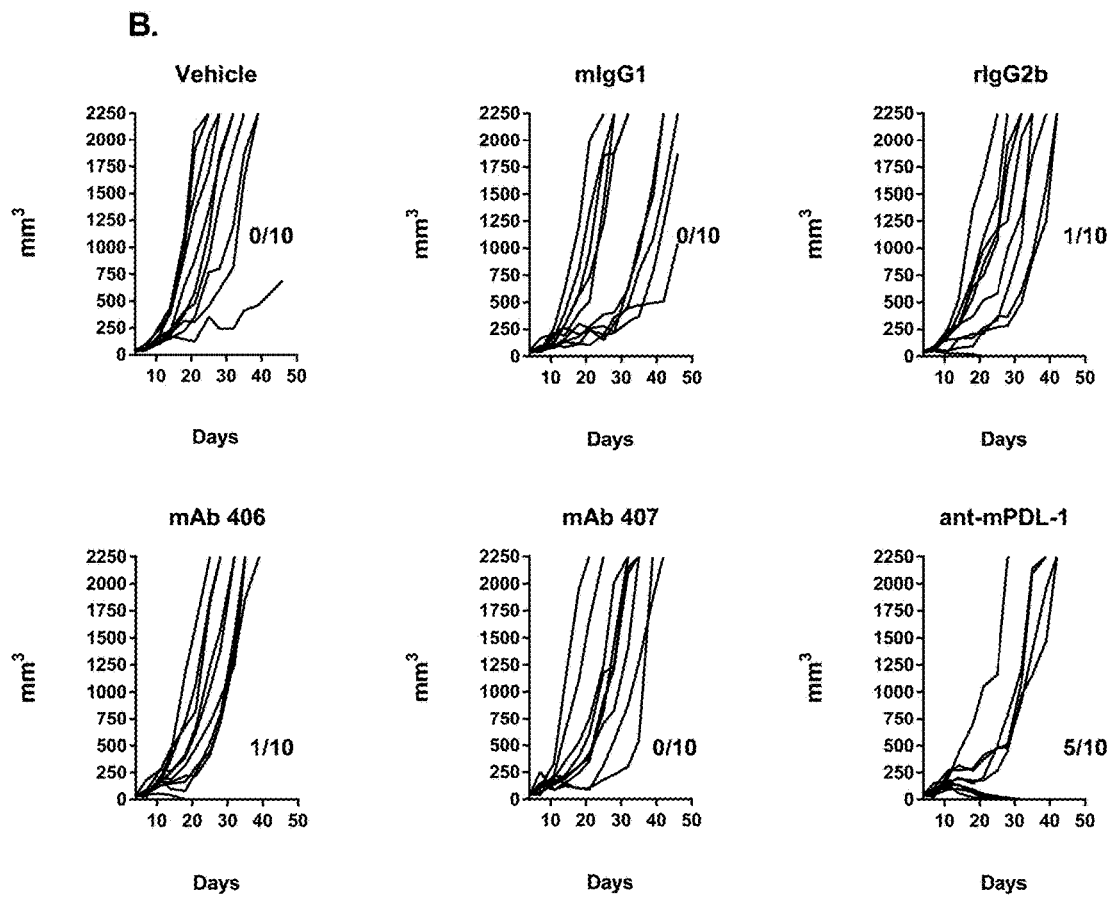
Figure 47C:
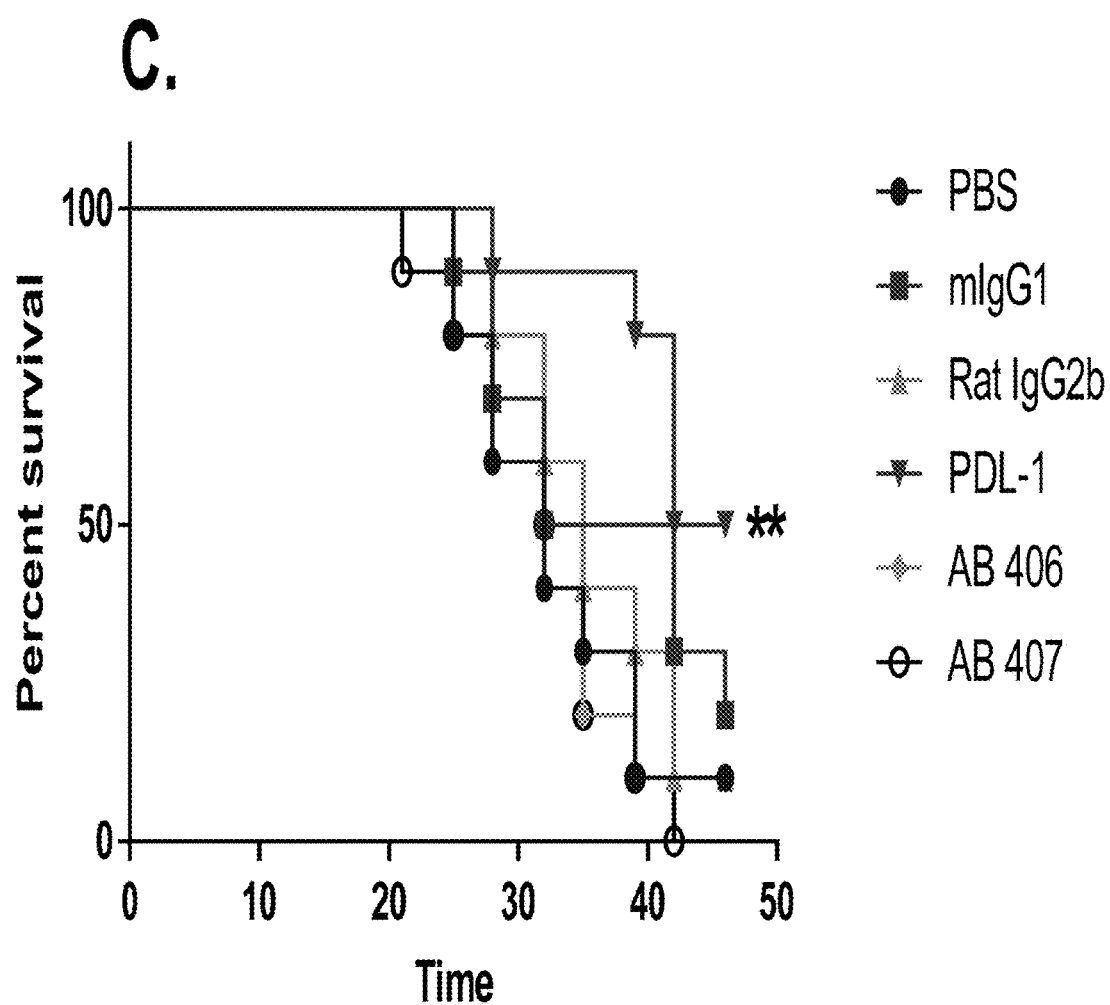

FIG. 47A-47C depict antitumor responses of anti-mPVRIg and anti-PDL-1 antibodies in CT26 tumor model. A-B. Groups of 10 BALB/c mice were subcutaneously injected with $5 \times 10^5$ CT26 cells. After tumors were measured on day 4, mice were randomized (40 mm3 mean tumor volume per group) and then treated with the designated mAb (100 or 200 µg/dose IP) followed by additional doses on days 7, 11, 14, 18 and 21. A. Groups were treated with 6 doses of single agents. Anti-PDL-1 vs control *p<0.0001. Tumor volumes are represented as the Mean volume+SEM. B. Tumor volumes were measured twice weekly. The number of tumor-free (TF) mice per group is indicated. C. survival proportions of assigned groups; Anti-PDL-1 vs control p=0.005.

Figure 48A:
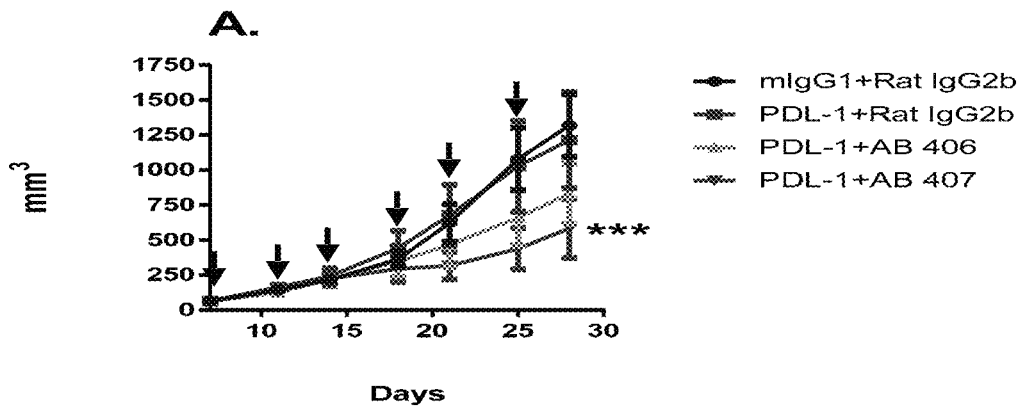
Figure 48B:
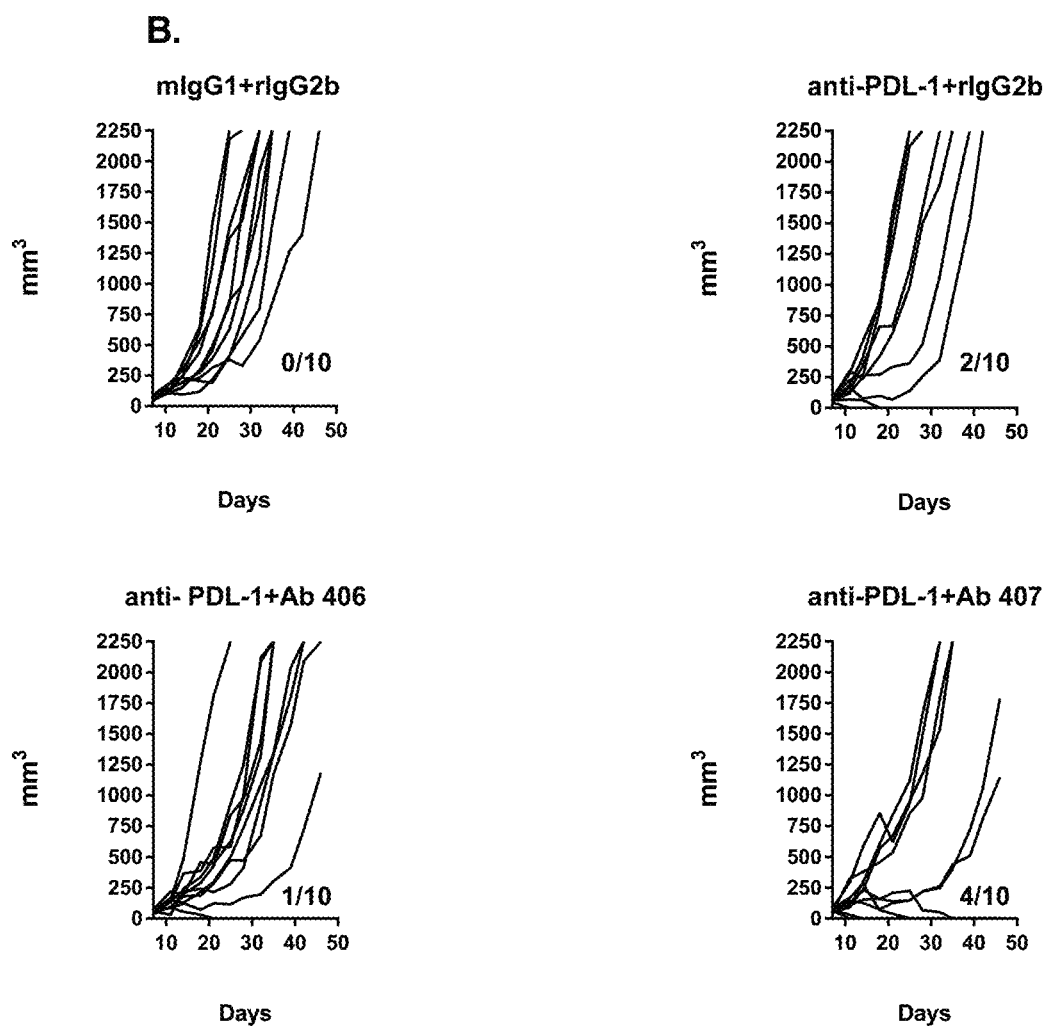
Figure 48C:
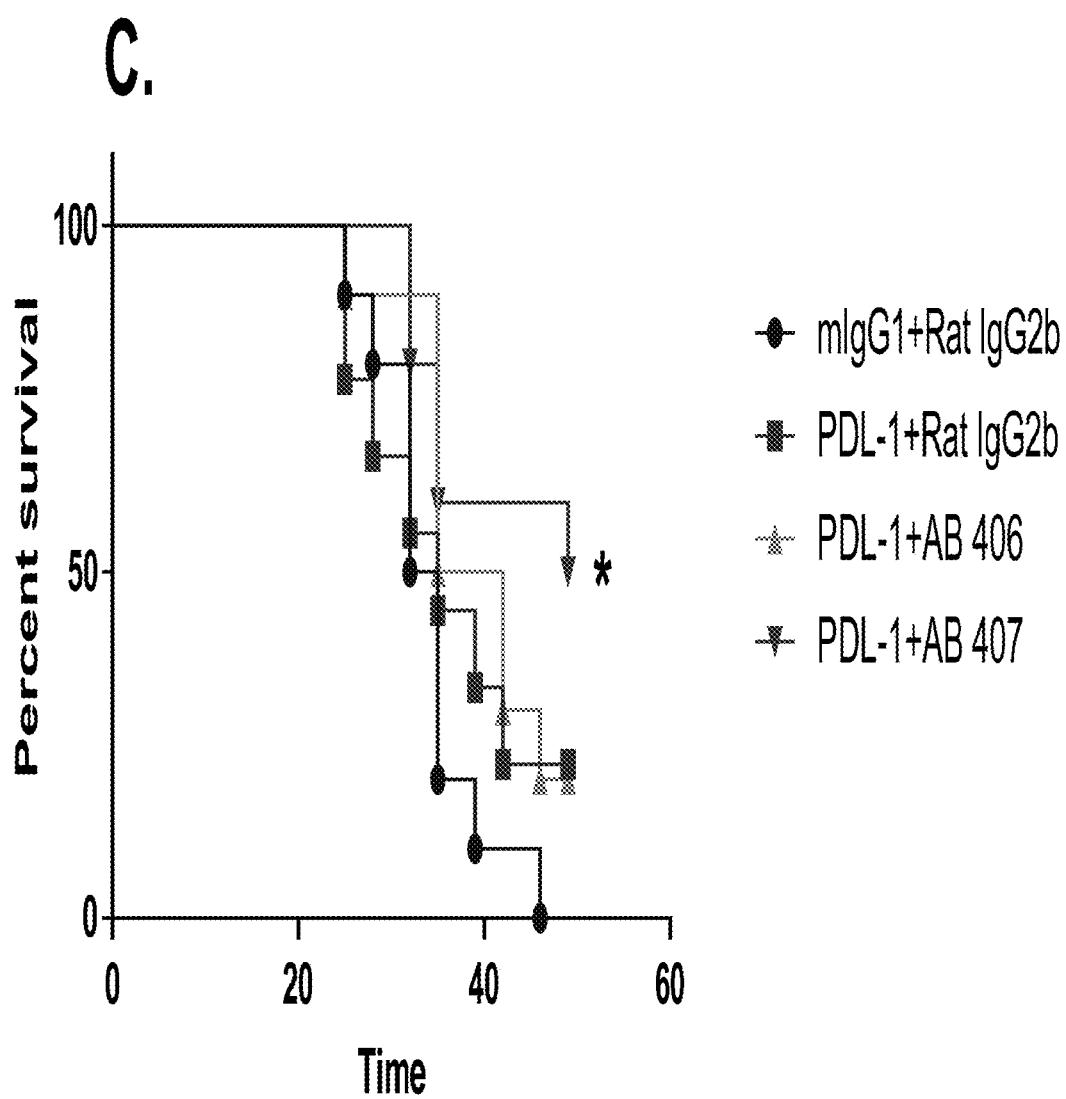

FIG. 48A-48C depict antitumor responses of anti-PVRIG and anti-PDL-1 antibodies combination in CT26 tumor model. A-B. Groups of 10 BALB/c mice were subcutaneously injected with $5 \times 10^5$ CT26 cells. After tumors were measured on day 7, mice were randomized (75 mm³ mean tumor volume per group) and then treated with the designated mAb (300 µg/dose IP) followed by additional doses on days 11, 14, 18, 21 and 25. A. Groups were treated with 6 doses of combined agents. Anti-PDL-1+Ab 407 vs control p=0.0005; anti-PDL-1 and mAb 406 vs control p=0.056. B. Tumor volumes were measured ×3 weekly. The number of tumor-free (TF) mice per group is indicated. C. survival proportions of assigned groups; Anti-PDL-1+mAb 407 vs control p=0.0088.

FIG. 49A-49D depict the amino acid sequences and the nucleic acid sequence for the variable heavy chain (A and B, respectfully) and the amino acid sequences and the nucleic acid sequence for the variable light chain (C and D, respectfully) for AB-407 (BOJ-5G4-F4).

FIGS. 50A and 50B depicts the amino acid sequences of the constant domains of human IgG1 (with some useful amino acid substitutions), IgG2, IgG3, IgG4, IgG4 with a hinge variant that finds particular use in the present invention, and the constant domains of the kappa and lambda light chains.

FIG. 51 depicts the sequences of human and cynomolgus macaque (referred to as cyno) TIGIT ECD and of the human PVR ECD proteins.

FIG. 52. Shows the flow cytometry binding summary for anti-TIGIT fabs. All unique ELISA positive fabs were analyzed by flow cytometry. The mean fluorescence intensity (MFI) was measured for the human or cyno TIGIT over-expressing Expi293 cells as well as the parental Expi293 cells. The MFI ratio for the target-specific vs off-target binding was calculated. Data for selected clones is shown.

FIG. 53A-53C depict the sequences of anti-TIGIT antibodies. Unless otherwise noted, the CDRs utilize the IMGT numbering (including the antibodies of the sequence listing.

FIG. 54. Shows the FACS KD results of anti-TIGIT mAbs binding to Expi293 human TIGIT over-expressing cells as described in Example 12.

FIG. 55. Shows the FACS KD results of mAbs binding to Expi293 cyno TIGIT over-expressing cells.

FIG. 56. Shows the results from Example 14, showing the resulting kinetic rate constants and the equilibrium dissociation constants where data were reliable enough to estimate the binding constants.

Figure 57A:
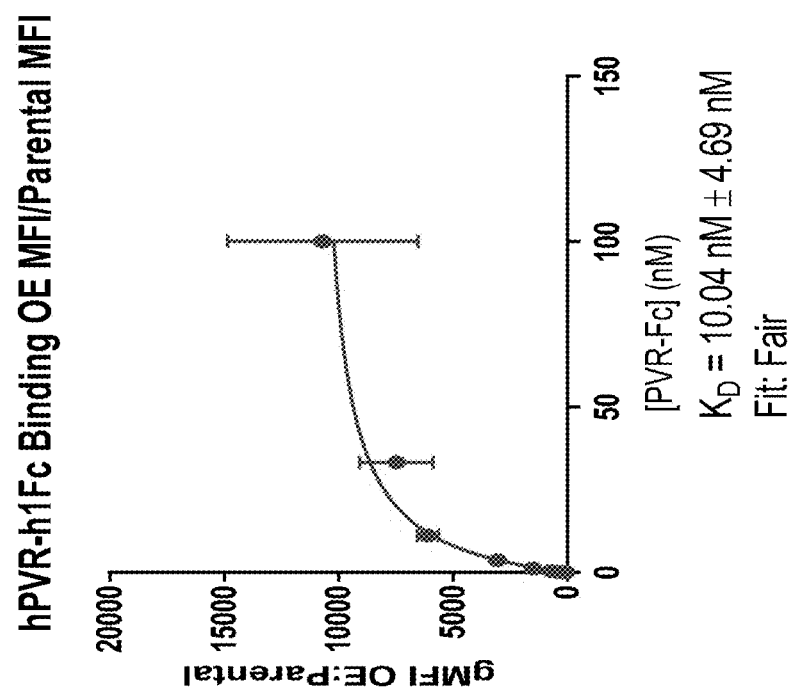
Figure 57B:
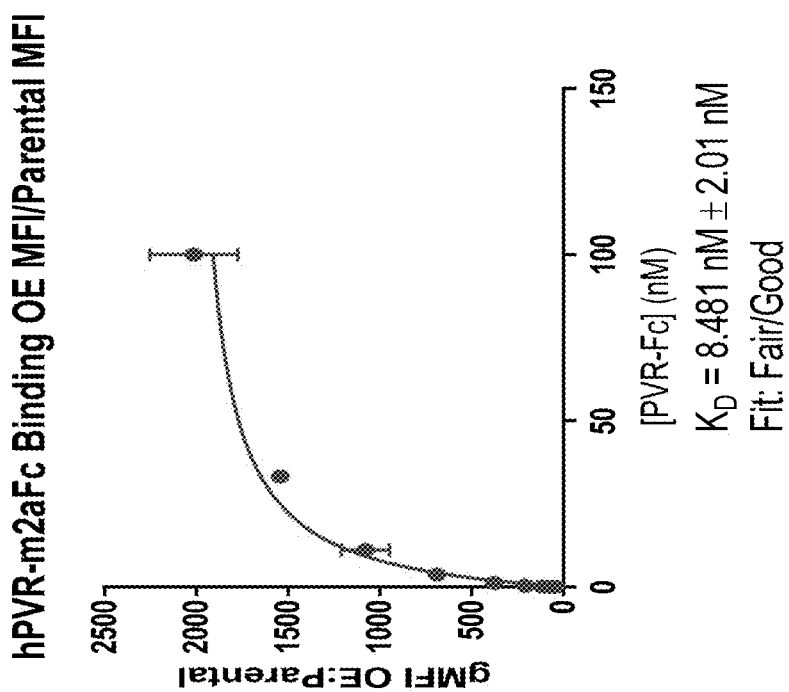

FIGS. 57A and 57B show the results of human PVR-Fc variant binding to Expi293 human TIGIT over-expressing cells in Example 4. Figure A (left): Binding curve generated for human PVR-m2aFc construct titrated with Expi293 human TIGT over-expressing cells. The KD and 95% confidence interval are shown. Figure B (right): Binding curve generated for human PVR-h1Fc construct titrated with Expi293 human TIGT over-expressing cells. The KD and 95% confidence interval are shown.

FIG. 58. Shows a table of phage antibodies inhibiting human PVR-m2aFc binding to human TIGIT over-expressed on Expi293 cells. mAbs were tested against known blocking (BM26) benchmark antibody, and human IgG4 isotype control (Synagis) antibody. A "Yes" indicates the mAb inhibited hPVR analogous to BM26.

FIG. 59. Shows a table of IC50 values of anti-TIGIT hybridoma antibodies inhibiting binding of human PVR-h1Fc to human TIGIT over-expressed on Expi293 cells. Values are representative of one of two independent experiments. The IC50 results for the two independently performed experiments showed a range of only 1.2-2-fold differences.

Figure 60:
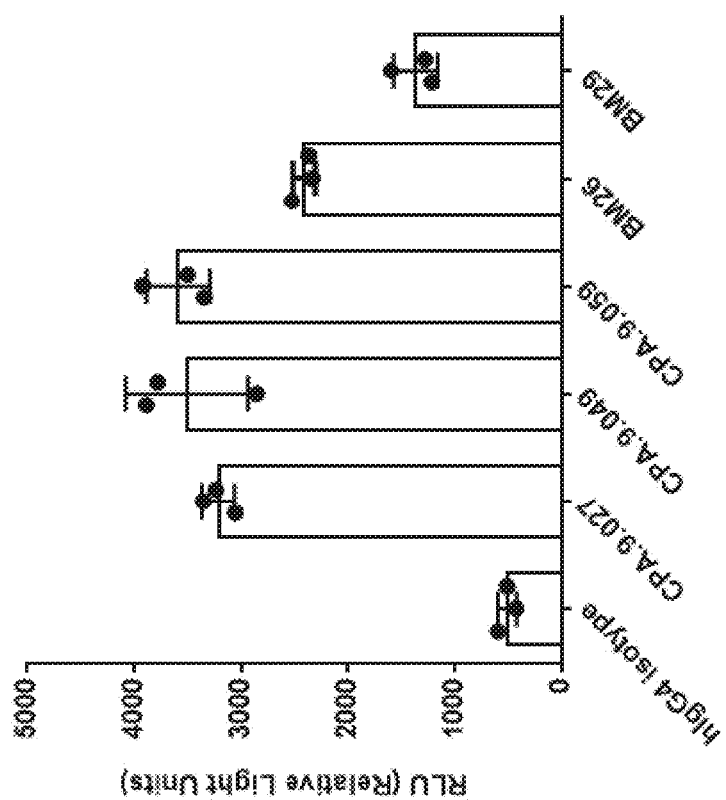

FIG. 60. Shows the results of Example 6, that the phage-derived and BM anti-human TIGIT antibodies, CPA.9.027, CPA.9.049, CPA.9.059, BM26, and BM29 increase IL-2 signaling. BM26 and BM29 are both the human IgG4 (hIgG4 with a S241P variant) isotype. Representative data (n≥2) shows the RLU (mean+/−standard deviation) of the luciferase signal from a 6 hour co-culture of Jurkat IL-2-RE luciferase human TIGIT cells and aAPC CHO-K1 human PVR cells. The concentration of each antibody was 10 µg/ml.

Figure 61:
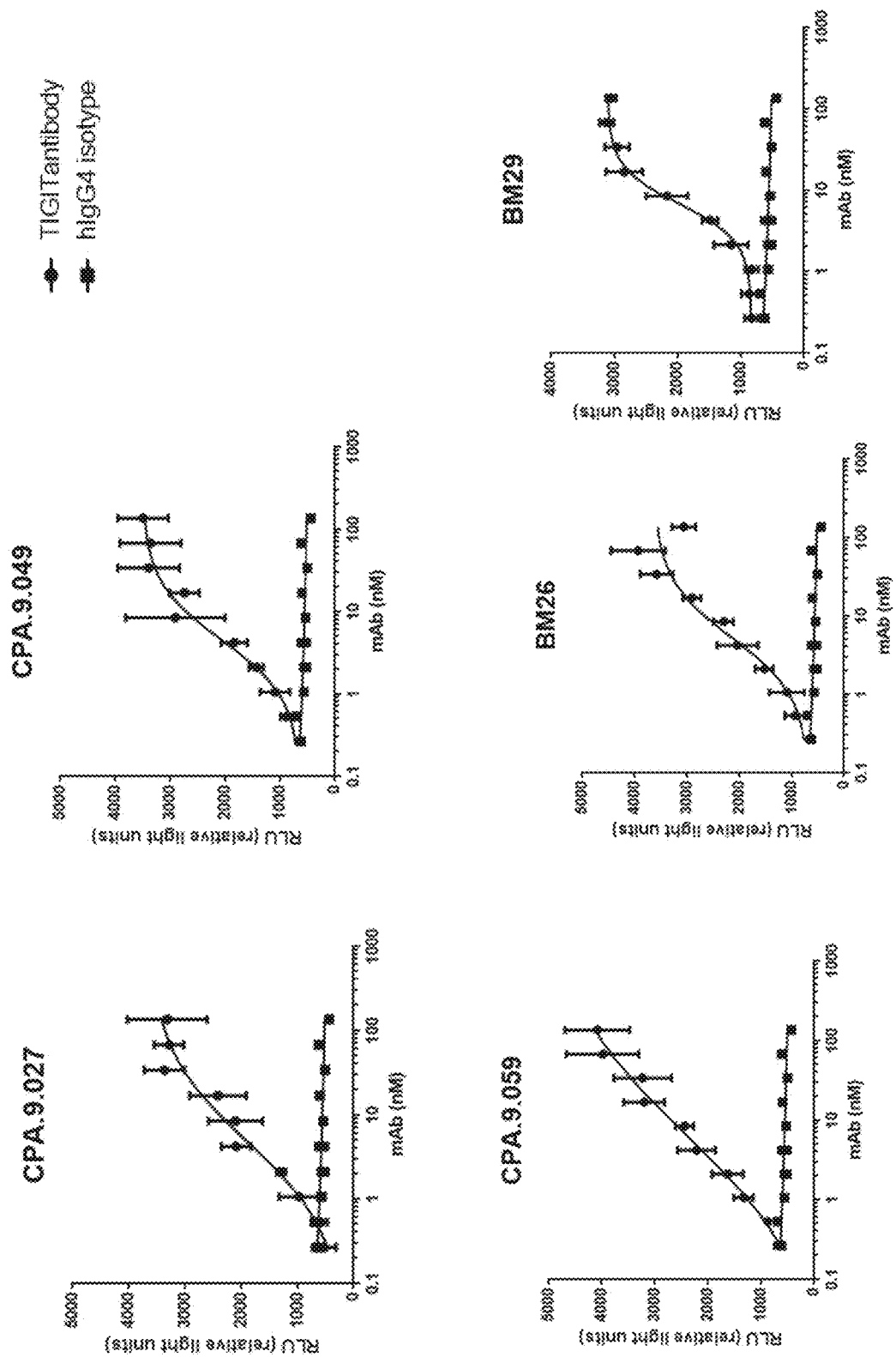

FIG. 61. Shows additional results of Example 6, that the phage-derived and BM hIgG4 anti-human TIGIT antibodies, CPA.9.027, CPA.9.049, CPA.9.059, BM26, and BM29 increase IL-2 signaling in a dose-dependent manner. BM26 and BM29 are both the hIgG4 isotype. Representative data (n≥2) shows the RLU (mean+/−standard deviation) of the luciferase signal from a 6 hour co-culture of Jurkat IL-2-RE luciferase human TIGIT cells and aAPC CHO-K1 human PVR cells. A 10 point, 2-fold dilution series starting at 20 µg/ml was used for each antibody.

Figure 62:
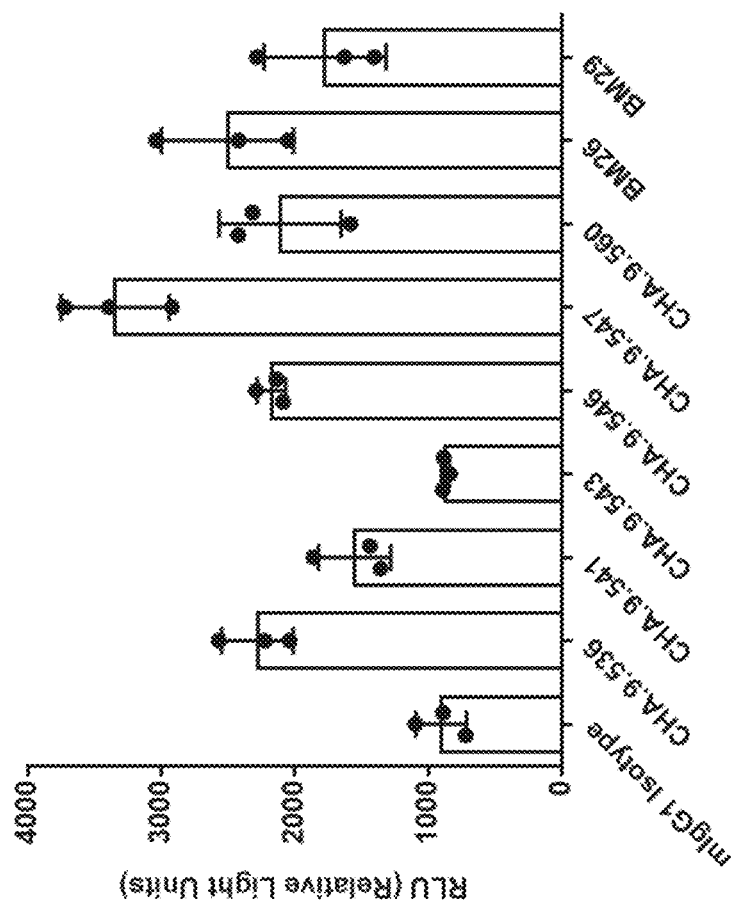

FIG. 62. Shows the results of Example 6, that the hybridoma-derived and BM anti-human TIGIT antibodies, CHA.9.536, CHA.9.541, CHA.9.546, CHA.9.547, CHA.9.560, BM26, and BM29 increase IL-2 signaling. BM26 and BM29 are both the mIgG1 isotype. The non-blocking anti-human TIGIT antibody, CHA.9.543 does not enhance IL-2 signaling. Representative data (n≥2) shows the RLU (mean+/−standard deviation) of the luciferase signal from a 6-hour co-culture of Jurkat IL-2-RE luciferase human TIGIT cells and aAPC CHO-K1 human PVR cells. The concentration of each antibody was 10 µg/ml.

Figure 63:
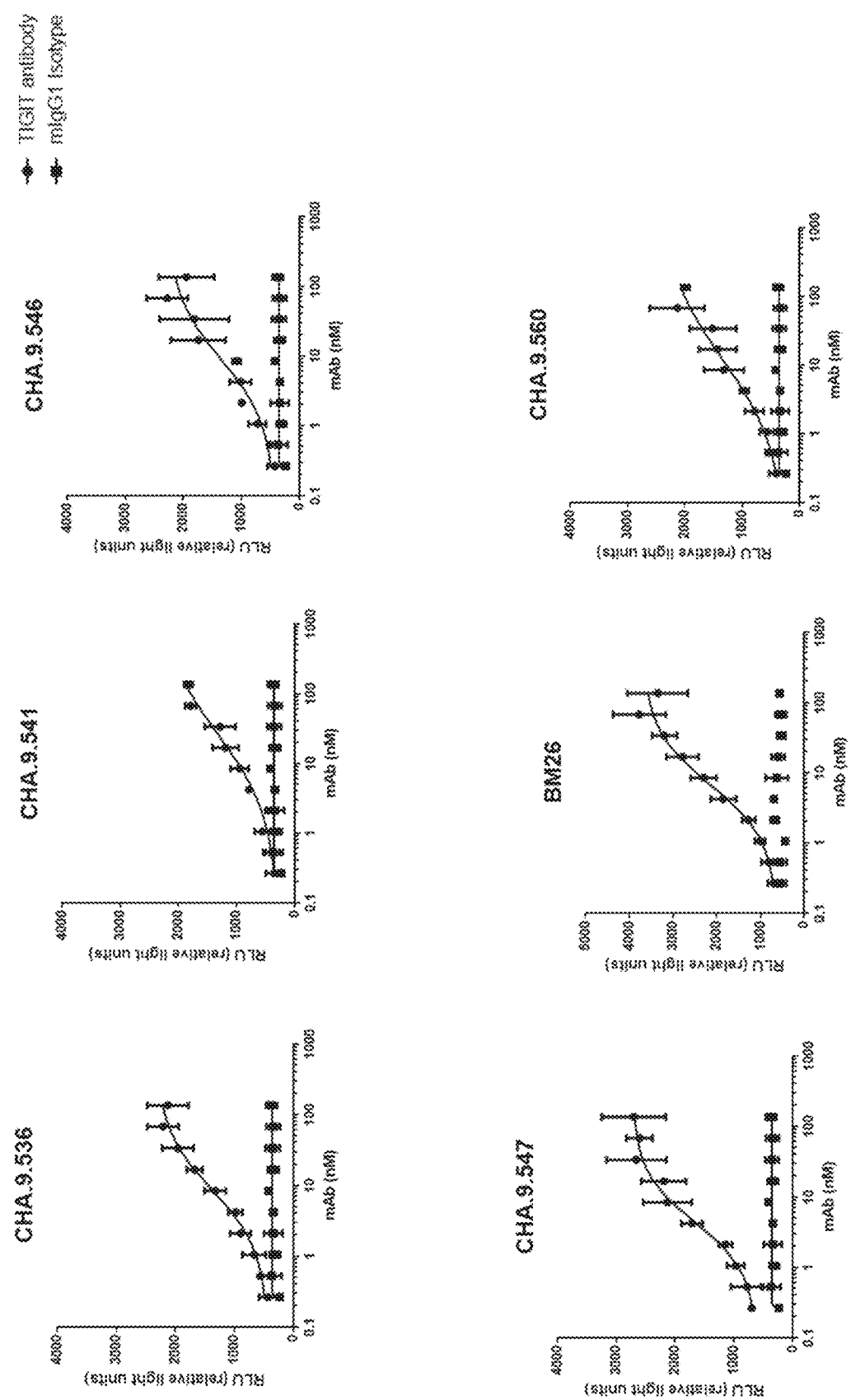

FIG. 63. Shows the results of Example 6, that the hybridoma-derived and benchmark mIgG1 anti-human TIGIT antibodies, CHA.9.536, CHA.9.541, CHA.9.546, CHA.9.547, CHA.9.560, and BM26 increase IL-2 signaling in a dose-dependent manner. BM26 is the mIgG1 isotype.

Representative data (n≥2) shows the RLU (mean+/−standard deviation) of the luciferase signal from a 6 hour co-culture of Jurkat IL-2-RE luciferase human TIGIT cells and aAPC CHO-K1 human PVR cells. A 10 point, 2-fold dilution series starting at 20 µg/ml was used for each antibody.

Figure 64:
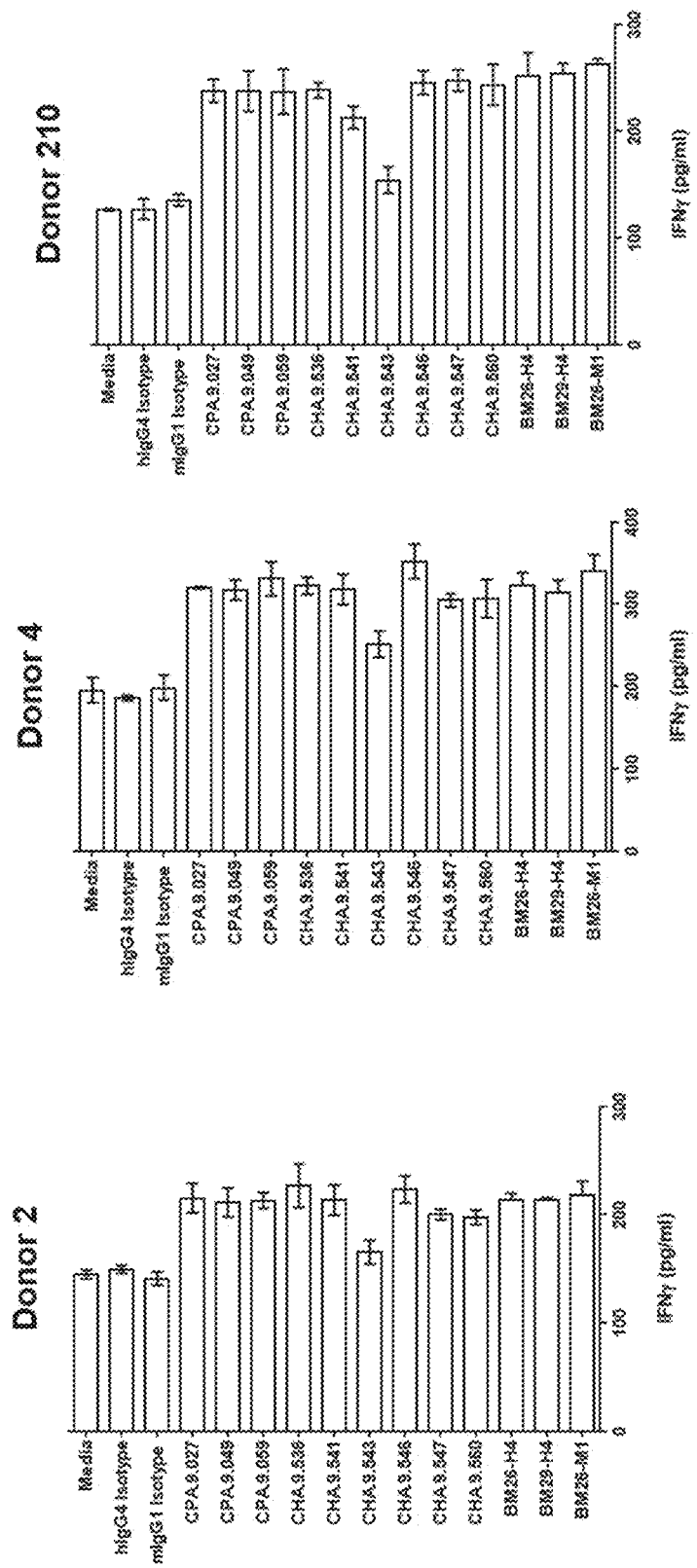

FIG. 64. Shows that the phage, hybridoma and BM anti-human TIGIT antibodies, CPA.9.027, CPA.9.049, CPA.9.059, CHA.9.536, CHA.9.541, CHA.9.546, CHA.9.547, CHA.9.560, BM26, and BM29 increase antigen-specific IFNγ signaling. BM26 is tested as both the hIgG4 and mIgG1 isotypes, while BM29 is only tested as the hIgG4 isotype. Representative data (n=2) shows the amount of IFNγ (mean+/−standard deviation) in the culture supernatant after 24-hour co-culture of CMV-specific CD8+ T cells with the Mel624 human PVR cells. The concentration of each antibody was 10 µg/ml. The Mel624 human PVR used in the assay were pulsed with 0.0033 µg/ml or 0.001 µg/ml peptide.

Figure 65:
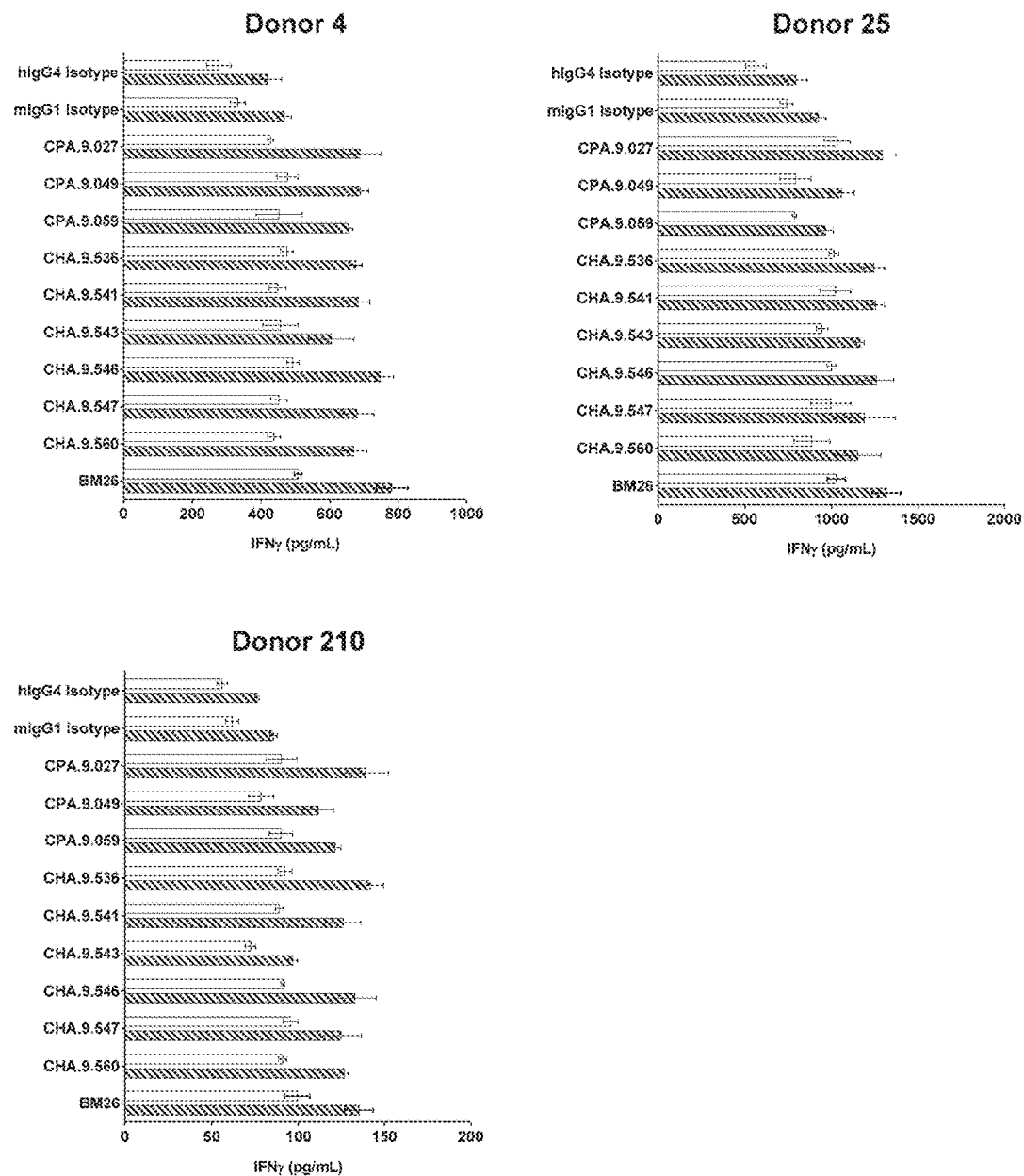

FIG. 65. Shows that the phage, hybridoma and BM anti-human TIGIT antibodies, CPA.9.027, CPA.9.049, CPA.9.059, CHA.9.536, CHA.9.541, CHA.9.546, CHA.9.547, and CHA.9.560, as well as BM26, increase antigen-specific IFNγ signaling either alone (open bars) or in combination with an anti-PVRIG antibody, CHA.7.518.1.H4(S241P) (hatched bars). BM26 is the mIgG1 isotype. For the isotype antibody control treatments, the open bar refers to the isotype antibody alone, and the hatched bar refers to isotype antibody in combination with CHA.7.518.1.H4(S241P). Representative data (n=2) shows the amount of IFNγ (mean+/−standard deviation) in the culture supernatant after a 24 hour co-culture of CMV-specific CD8+ T cells with Mel624 cells over-expressing human PVR and human PVRL2. The concentration of each antibody was 10 µg/ml. The Mel624 human PVR/human PVRL2 cells used in the assay were pulsed with 0.0033 µg/ml or 0.001 µg/ml peptide.

FIG. 66. Shows the percent increase of IFNγ secretion with anti-human TIGIT antibodies, CHA.7.518.1.H4 (S241P), and the combination of anti-human TIGIT antibodies and CHA.7.518.1.H4(S241P), over the respective isotype control antibodies.

Figure 67:
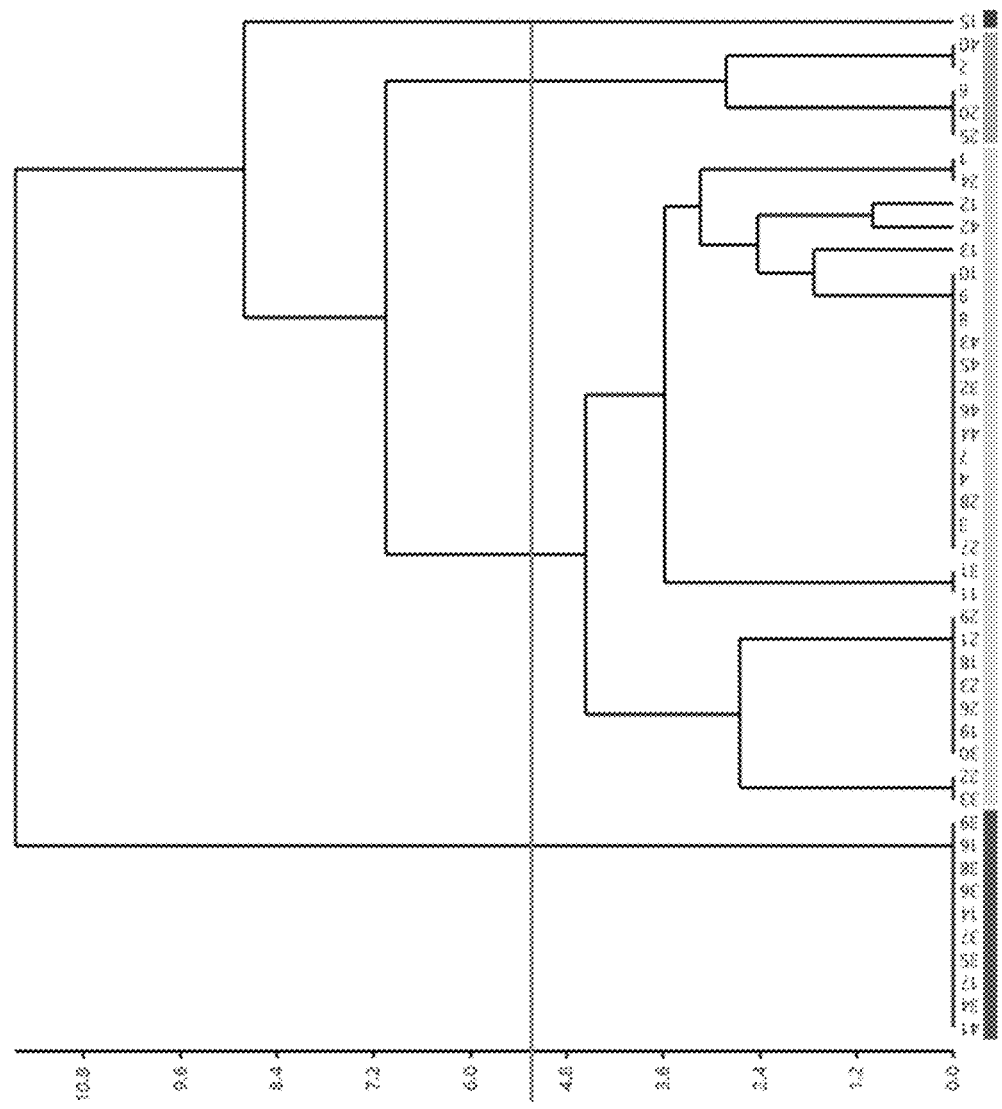

FIG. 67 is the dendrogram for the epitope binning experiments of Example 7.

FIG. 68 is the grouping of the antibodies from the epitope binning experiments of Example 7.

Figure 69:
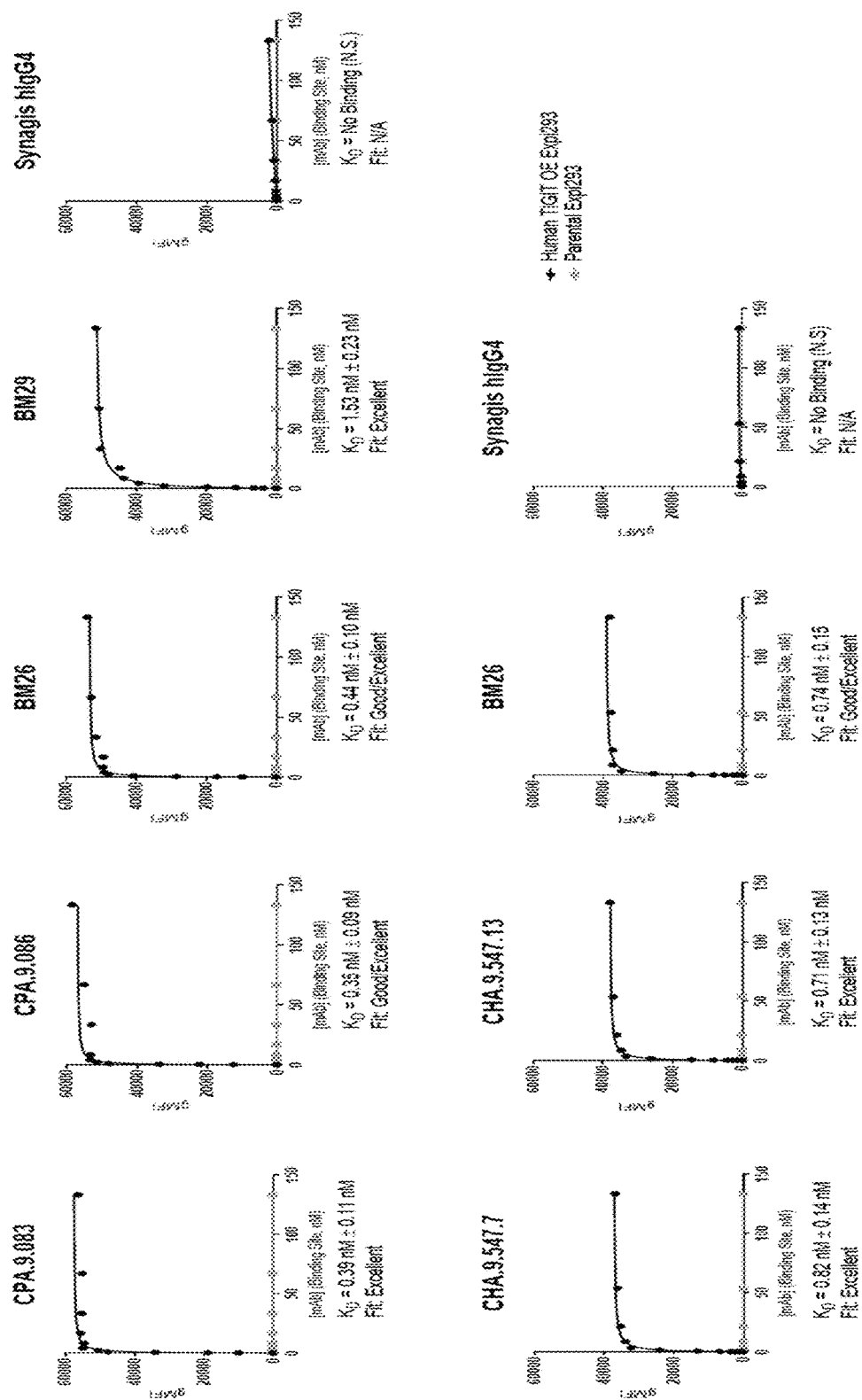

FIG. 69. Shows the high affinity binding to human TIGIT overexpressing cells in a dose titration of the affinity matured phage antibodies (CPA.9.083, CPA.9.086), humanized hybridoma antibodies (CHA.9.547.7, CHA.9.547.13), benchmark antibodies (BM26, BM29), and the hIgG4 isotype control (anti-Synagis) on human TIGIT over-expressing Expi293 cells, as described in experiments of Example 3. All antibodies were titrated using a serial 2-fold dilution over 11 points starting at 10 µg/ml (133.33 nM [binding site]). AF647-labeled goat anti-human F(ab') (Jackson Immunoresearch) was added to the cells to detect binding of anti-TIGIT antibodies. The gMFI of the anti-TIGIT antibodies bound to the human TIGIT over-expressing Expi293 cells (black line), and the parental Expi293 cells (grey line) are shown. $K_D$ values+/−95% CI, and curve fits are indicated below each graph.

Figure 70:
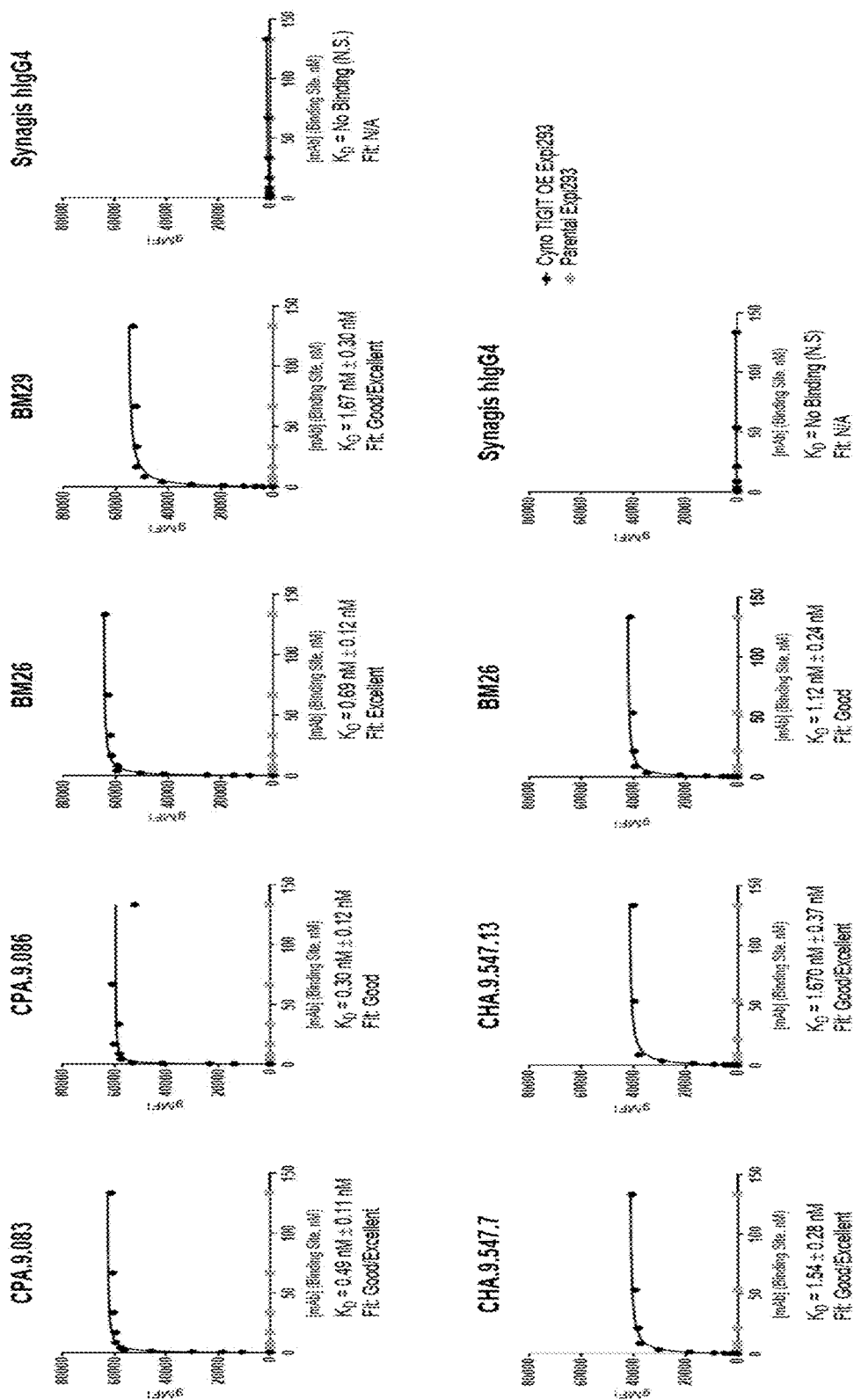

FIG. 70. Shows that anti-TIGIT antibodies are cross reactive to cyno TIGIT in a dose titration of the affinity matured phage antibodies (CPA.9.083, CPA.9.086), humanized hybridoma antibodies (CHA.9.547.7, CHA.9.547.13), benchmark antibodies (BM26, BM29), and the hIgG4 isotype control (anti-Synagis) on cyno TIGIT over-expressing Expi293 cells, as described in experiments of Example 3. All antibodies were titrated using a serial 2-fold dilution over 11 points starting at 10 µg/ml (133.33 nM [binding site]). AF647-labeled goat anti-human F(ab') (Jackson Immunoresearch) was added to the cells to detect binding of anti-TIGIT antibodies. The gMFI of the anti-TIGIT antibodies bound to the cyno TIGIT over-expressing Expi293 cells (black line), and the parental Expi293 cells (grey line) are shown. $K_D$ values+/−95% CI, and curve fits are indicated below each graph.

Figure 71A:
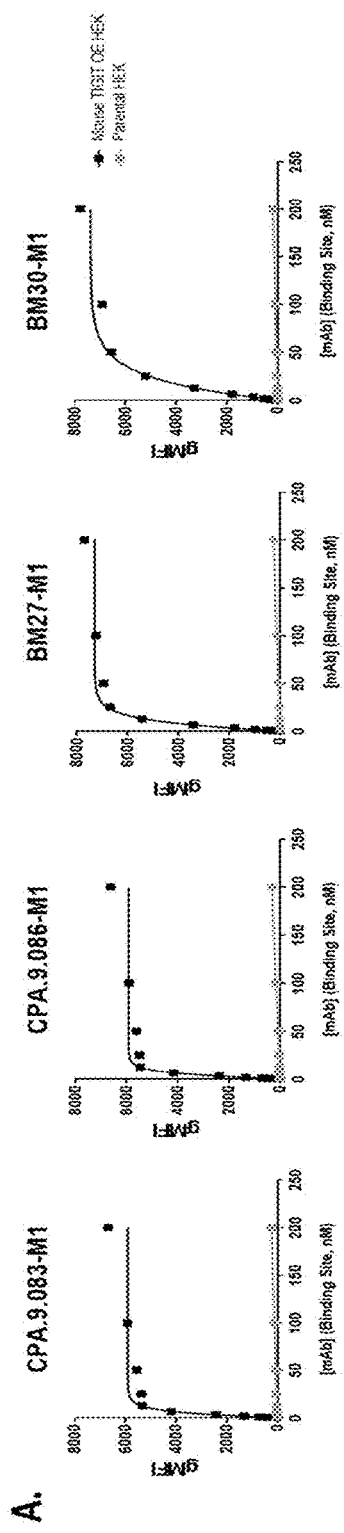
Figure 71B:
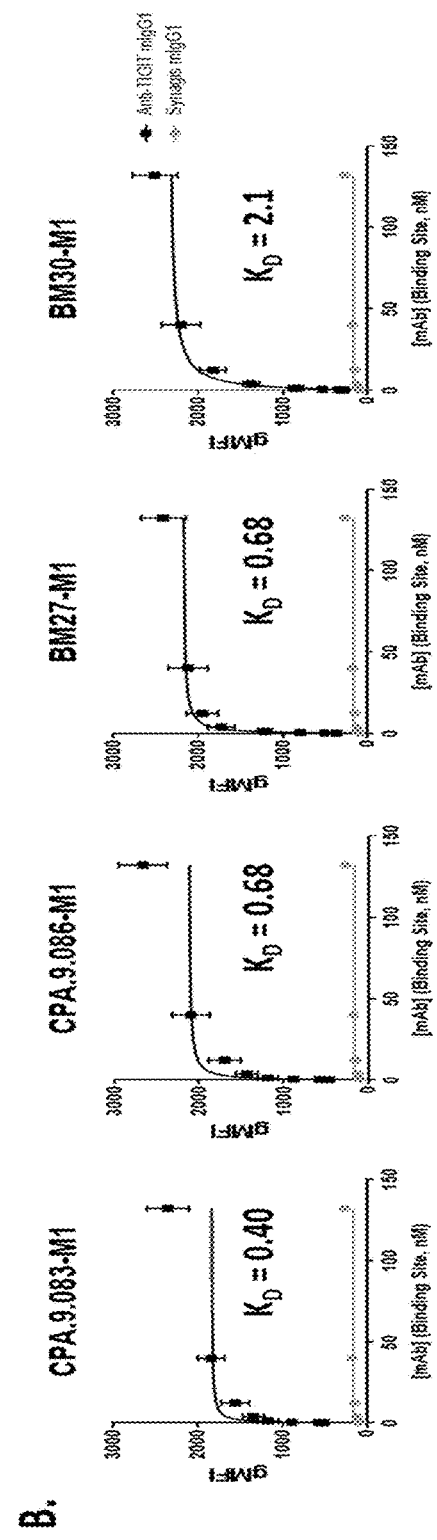

FIGS. 71A and 71B. Shows that affinity matured phage antibodies are cross reactive to mouse TIGIT in a dose titration of the affinity matured phage antibodies reformatted as mouse IgG1 (mIgG1) (CPA.9.083, CPA.9.086), benchmark anti-mouse TIGIT antibodies (BM27 mIgG1, BM30 mIgG1), and the mIgG1 isotype control (anti-Synagis) are shown, as described in experiments of Example 3. A) The gMFI of the anti-TIGIT antibodies bound to the mouse TIGIT over-expressing HEK cells (black line), and the parental HEK cells (grey line). B) The gMFI of the anti-TIGIT antibodies (black line) or Synagis mIgG1 (grey line) bound to regulatory CD4+CD25+Foxp3+ T cells isolated from s.c. implanted Renca tumors in Balb/c mice. Anti-TIGIT antibodies were titrated using either a serial 2- or 3-fold dilution series starting at 15 µg/ml (200 nM [binding site]), or 10 µg/ml (132 nM [binding site]), respectively. AF647-labeled goat anti-mouse IgG-Fc (Southern Biotech) were added to the cells to detect binding of the anti-TIGIT antibodies on mouse TIGIT over-expressing cells. Anti-TIGIT antibodies were directly conjugated to AF647 for mouse Treg binding. $K_D$ values for each anti-TIGIT antibody are indicated.

Figure 72:
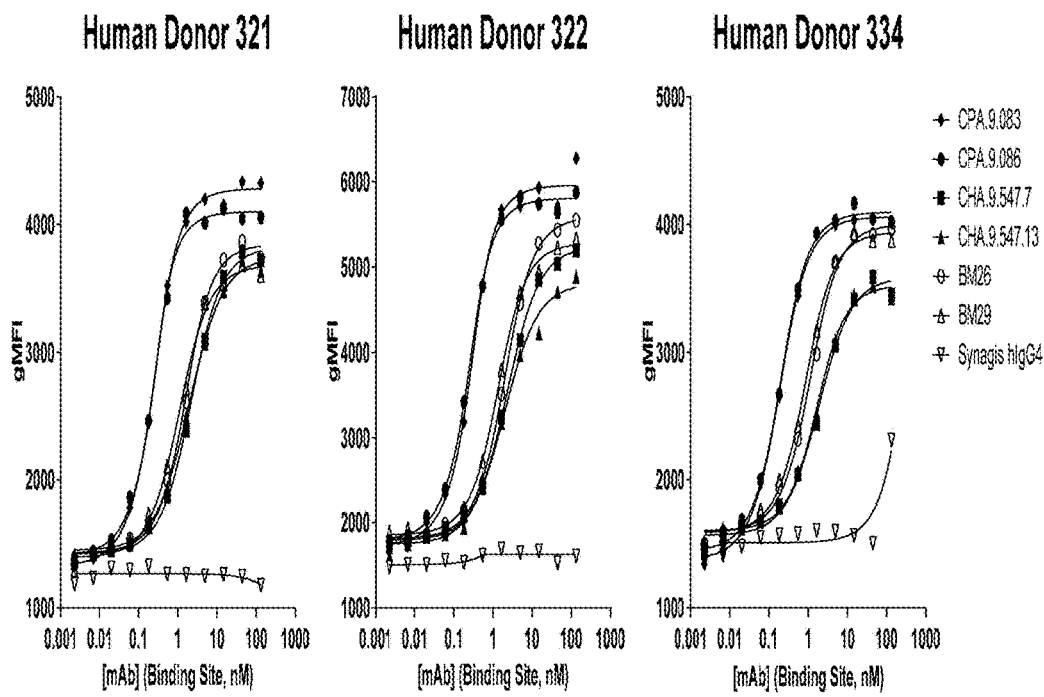

FIG. 72. Shows a dose titration of the affinity matured phage antibodies (CPA.9.083, CPA.9.086), humanized hybridoma antibodies (CHA.9.547.7, CHA.9.547.13), and benchmark antibodies (BM26, BM29) on human effector memory CD95+CD28-CD8+CD3+ T cells from 3 healthy donor PBMCs (Donors 321, 322, and 334), as described in experiments of Example 3. PBMCs were surface stained with antibodies against the following lineage markers CD3, CD4, CD8, CD14, CD16, CD28, CD56, and CD95 (BD Biosciences, BioLegend), as well as live/dead fixable aqua dye (Life Technologies). AF647-labeled anti-TIGIT antibodies and hIgG4 isotype control antibody (anti-Synagis) were then titrated using a serial 3-fold dilution over 12 points starting at 30 µg/ml (396 nM [binding site]). The gMFI of the anti-TIGIT antibodies bound to the effector memory T cells are shown. KD values for each antibody across the 3 different donors are reported in the table. The affinity mature phage antibodies (CPA.9.083 and CPA.9.086) had the highest binding affinity to the human effector memory T cells.

Figure 73:
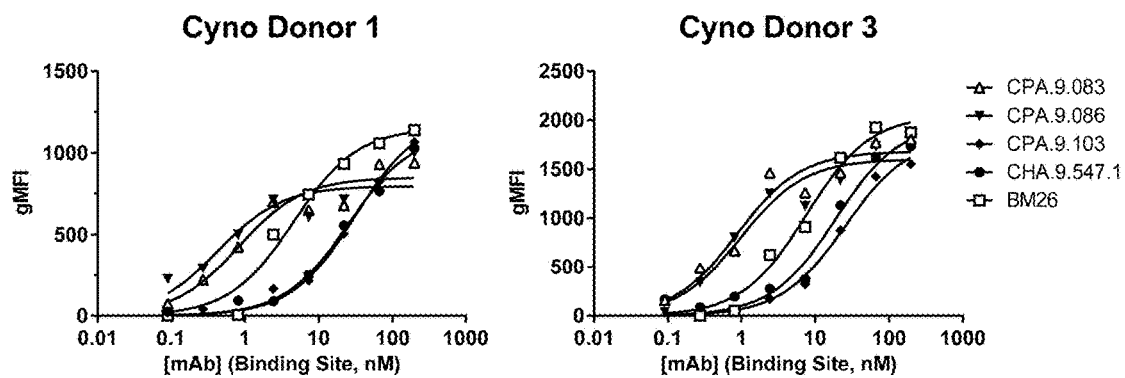

FIG. 73. Shows a dose titration of the affinity matured phage antibodies (CPA.9.083, CPA.9.086, CPA.9.103), humanized hybridoma antibody (CHA.9.547.1), and benchmark antibody (BM26) on cyno effector memory CD95+ CD28-CD8+CD3+ T cells from PBMCs isolated from 2 naïve cyno monkeys (BioreclamationIVT), as described in experiments of Example 3. PBMCs were surface stained with antibodies against the following lineage markers CD3, CD4, CD8, CD14, CD16, CD28, CD56, and CD95 (BD Biosciences, BioLegend), as well as live/dead fixable aqua dye (Life Technologies). AF647-labeled anti-TIGIT antibodies and hIgG4 isotype control antibody (anti-Synagis) were then titrated using a serial 3-fold dilution over 12 points starting at 30 µg/ml (396 nM [binding site]). The gMFI of the anti-TIGIT antibodies bound to the effector memory T cells are shown with the gMFI of the anti-Synagis hIgG4 isotype control antibody subtracted. $K_D$ values for each antibody across the 2 donors are reported in the table. The affinity mature phage antibodies (CPA.9.083 and CPA.9.086) had the highest binding affinity to the cyno effector memory T cells.

FIG. 74. Shows the SPR kinetics of anti-TIGIT antibody binding to human, cyno and mouse TIGIT, as described in experiments of Example 5. The kinetic rate and equilibrium dissociation constants for the affinity matured phage antibodies (CPA.9.083, CPA.9.086, CPA.9.103), humanized hybridoma antibodies (CHA.9.547.1 and CHA.9.547.7), and benchmark antibodies (BM26, BM29) were determined by SPR on the ProteOn instrument.

Figure 75:
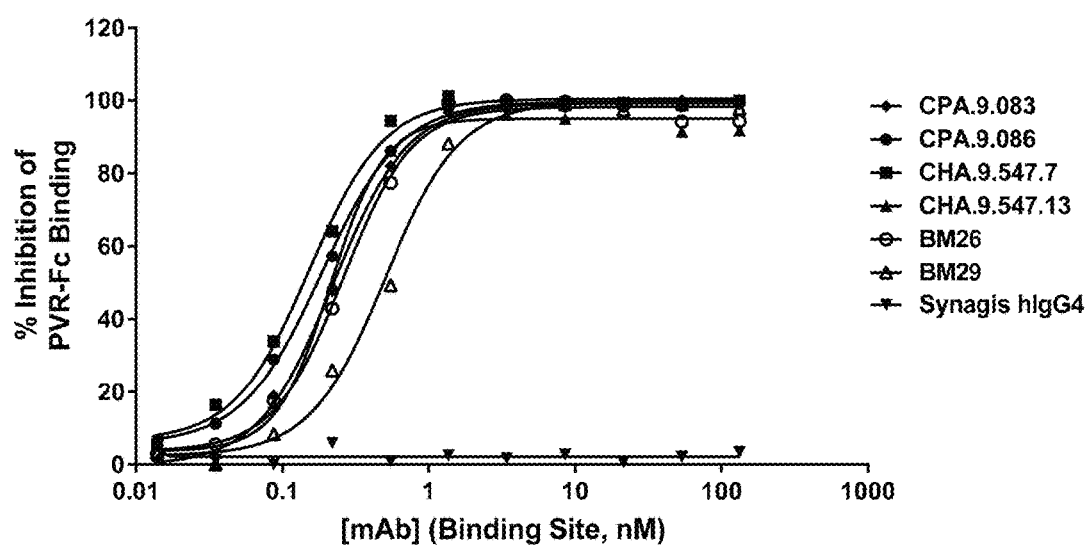

FIG. 75. Shows that the anti-TIGIT antibodies block PVR/TIGIT interactions, as described in experiments of Example 4. Human TIGIT over-expressing Expi293 cells were preincubated with either the affinity matured phage antibodies (CPA.9.083, CPA.9.086), humanized hybridoma antibodies (CHA.9.547.7, CHA.9.547.13), benchmark antibodies (BM26, BM29), or the hIgG4 isotype control (anti-Synagis). All antibodies were titrated using a serial 2.5-fold dilution over 11 points starting at 10 μg/ml (133.33 nM [binding site]). Following antibody preincubation, human PVR-m2aFc was added to the cells at 158 nM [binding site] or $EC_{90}$. AF647-labeled goat anti-mouse IgG-Fc (Southern Biotech) was then added to the cells to detect binding of anti-TIGIT antibodies. The percent inhibition of PVR-m2aFc binding to the human TIGIT over-expressing Expi293 cells is shown for each antibody. $IC_{50}$ values for each anti-human TIGIT antibody are reported in the table (n=2 experiments).

Figure 76:
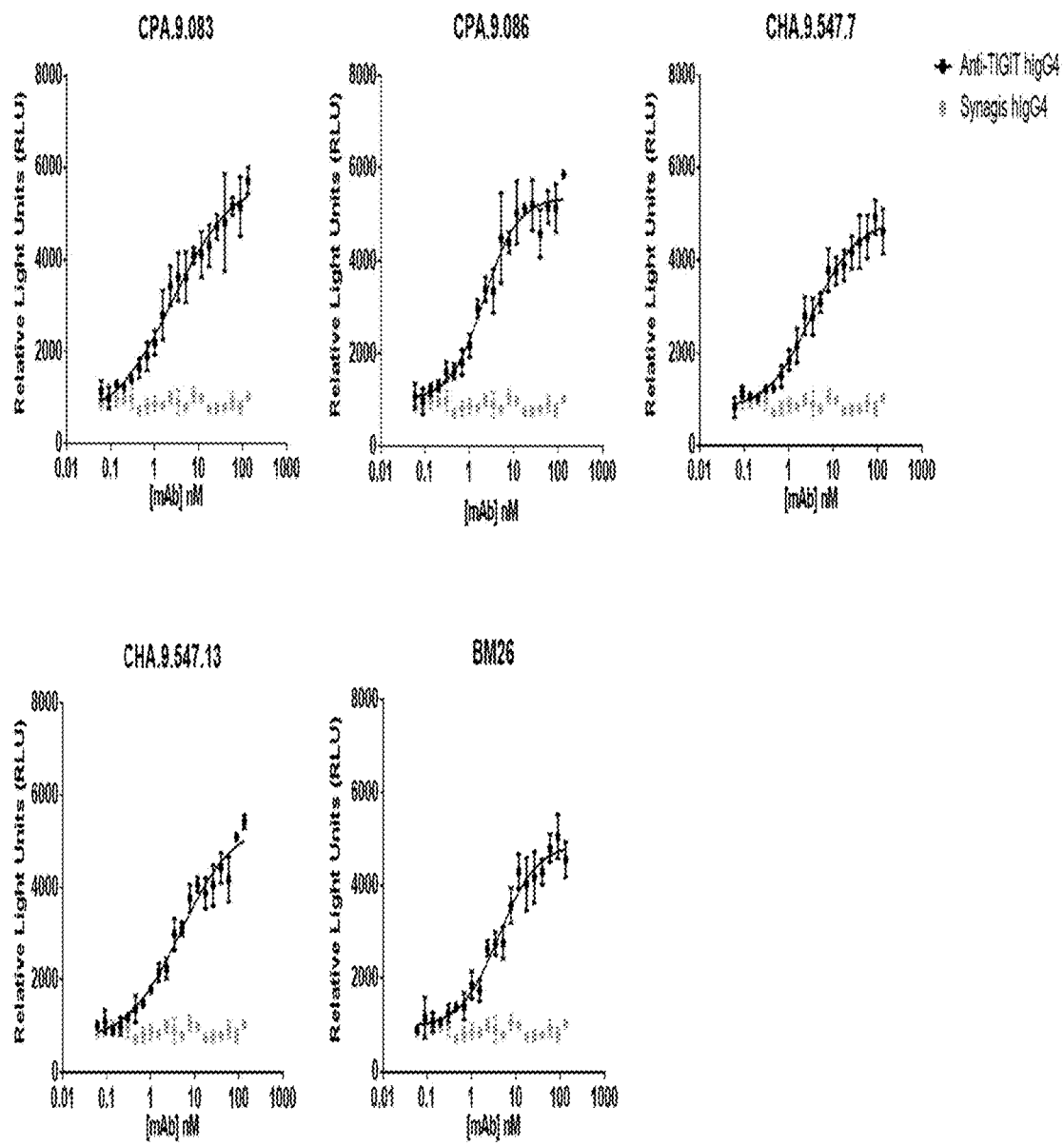

FIG. 76. Show the results of Example 6, that the affinity matured phage antibodies (CPA.9.083, CPA.9.086), humanized hybridoma antibodies (CHA.9.547.7, CHA.9.547.13), and benchmark antibody (BM26) increase IL-2 signaling in a dose-dependent manner. Synagis hIgG4 is the isotype control antibody. Representative data (n≥2) shows the RLU (mean+/−standard deviation) of the luciferase signal from a 6-hour co-culture of Jurkat IL-2-RE luciferase human TIGIT cells and CHO-K1 human PVR cells. A 19 point, 1.5-fold dilution series starting at 20 μg/ml was used for each antibody.

FIG. 77. Shows that anti-TIGIT antibodies induce IFNγ in CMV-specific CD8+ T cells. An in vitro co-culture assay with human CMV-specific CD8+ T cells was utilized to assess the effect of the affinity matured phage antibodies (CPA.9.083, CPA.9.086), humanized hybridoma antibodies (CHA.9.547.7, CHA.9.547.13), and benchmark antibodies (BM26, BM29) on antigen-specific cytokine secretion, as described in experiments of Example 6. The target cell line used in the assay was the HLA-A2+ pancreatic adenocarcinoma cells, Panc.05.04 that endogenously expresses human PVR and PVRL2. Panc.05.04 cells were pulsed with the CMV pp65 peptide at 0.03 μg/ml or 0.01 μg/ml at 37° C. for 1 hour. Cells were then washed and plated at 50,000 cells/well in 96-well round-bottom tissue culture treated plates. Anti-human TIGIT antibodies or the isotype control hIgG4 antibody (anti-Synagis) were added at a concentration of 0.1 μg/ml. Human CMV-specific CD8+ T cells from a single donor were expanded according to the protocol above. 50,000 human CD8+ T cells were added to each well. Co-cultures were incubated at 37° C. with 5% CO2 for 24 hours. The amount of human interferon gamma (IFNγ) in the co-culture supernatant was measured by flow cytometry using a cytometric bead assay (BD Biosciences). The percent increase of IFNγ secretion for each antibody over the hIgG4 isotype is summarized in the table (n=2 experiments).

Figure 78:
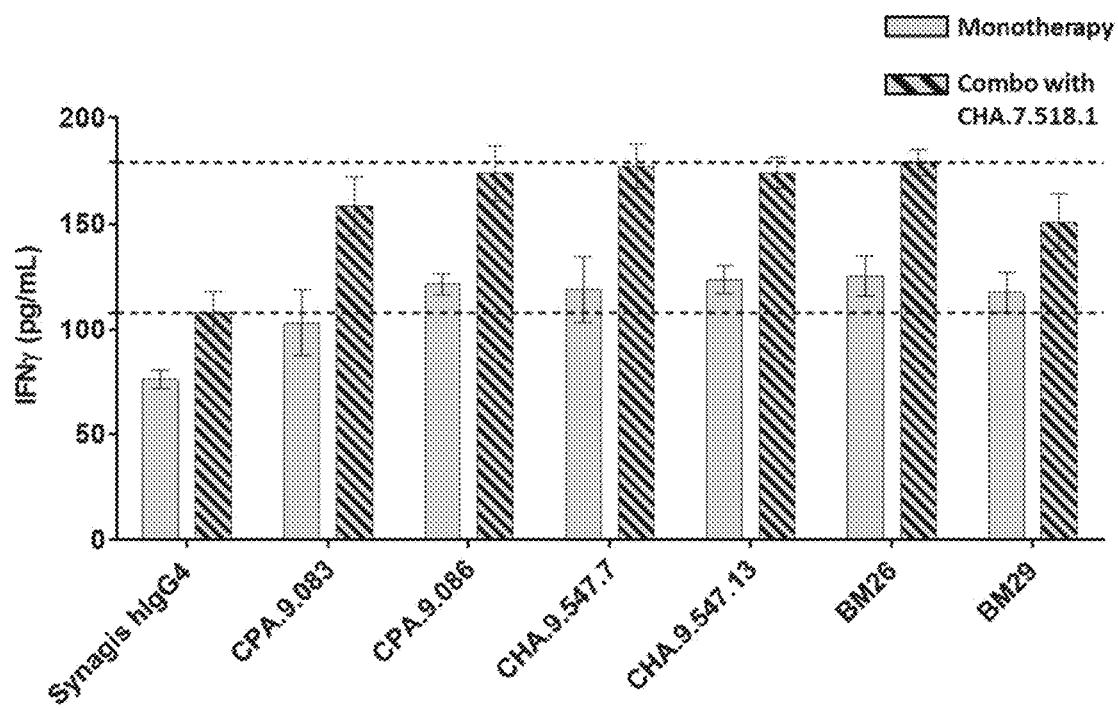

FIG. 78. Shows anti-TIGIT antibodies augment IFNγ when combined with a PVRIG antibody, CHA.7.518.1.H4 (S241P). An in vitro co-culture assay with human CMV-specific CD8+ T cells was utilized to assess the effect of the affinity matured phage antibodies (CPA.9.083, CPA.9.086), humanized hybridoma antibodies (CHA.9.547.7, CHA.9.547.13), and benchmark antibodies (BM26, BM29) on antigen-specific cytokine secretion in combination with an anti-PVRIG antibody, CHA.7.518.1. The target cell line used in the assay was the HLA-A2+ pancreatic adenocarcinoma cells, Panc.05.04 that endogenously expresses human PVR and PVRL2. Panc.05.04 cells were pulsed with the CMV pp65 peptide at 0.03 μg/ml or 0.01 μg/ml at 37° C. for 1 hour. Cells were then washed and plated at 50,000 cells/well in 96-well round-bottom tissue culture treated plates. Anti-human TIGIT antibodies or the isotype control hIgG4 antibody (anti-Synagis) were added at a concentration of 0.1 μg/ml in combination with CHA.7.518.1 (hatched bars) or a control hIgG4 isotype antibody at 10 μg/ml (solid bars). Human CMV-specific CD8+ T cells from a single donor were expanded according to the protocol above. 50,000 human CD8+ T cells were added to each well. Co-cultures were incubated at 37° C. with 5% CO2 for 24 hours. The amount of human IFNγ in the co-culture supernatant was measured by flow cytometry using a cytometric bead assay (BD Biosciences). The percent increase of IFNγ secretion for each antibody over the hIgG4 isotype is summarized in the table (n=2 experiments).

FIG. 79. Shows the correlation analysis of PVRIG and TIGIT expression on CD4+ and CD8+ T cells from dissociated tumors. For each tumor sample, a mean fluorescence intensity ratio (MFIr) was calculated, and a Spearman's correlation analysis was performed, and an r2 and p value reported.

FIGS. 80A-80C. Shows the results of tumor growth inhibition and survival in TIGIT KO mice treated with an anti-mouse PVRIG antibody. Groups of 7-10 TIGIT KO and C57BL/6 WT mice were s.c. injected with 1×10⁵ B16/Db-hmgp100 cells. Mice were treated twice per week for 3 weeks, starting at the inoculation day (day 0) with the designated antibody. A) Mean tumor volumes+/−standard error of the mean (SEM) are shown in the upper graph, with *** indicating a p-value <0.001 for TIGIT KO treated with anti-mouse PVRIG antibody (Clone 407) compared to C57BL/6 WT treated with the mIgG1 isotype control antibody. Tumor volumes for individual mice within each antibody treatment group are shown as spider plots in lower graphs. B) Table summarizing the TGI as measured at indicated days compared to control C57BL/6 WT mice treated with the mIgG1 isotype control. C) Survival of mice after s.c. injection of B16/Db-hmgp100 cells.

FIG. 81 depicts combination treatments with the indicated antibodies as compared to control in Mel-624, Colo205, and Panc.05.04 cells. gp100 or CMVpp65 specific T cells were co-cultured with Mel-624, Colo205, and Panc.05.04 cells, gp100 or CMVpp65 peptide, and the indicated antibodies at 10 mg/ml. IFN-γ concentration in the conditioned media was determined at 24 hrs. Average+Std Dev of triplicates is shown. % change in IFN-γ for each condition relative to hIgG4 is shown.

Figure 82A:
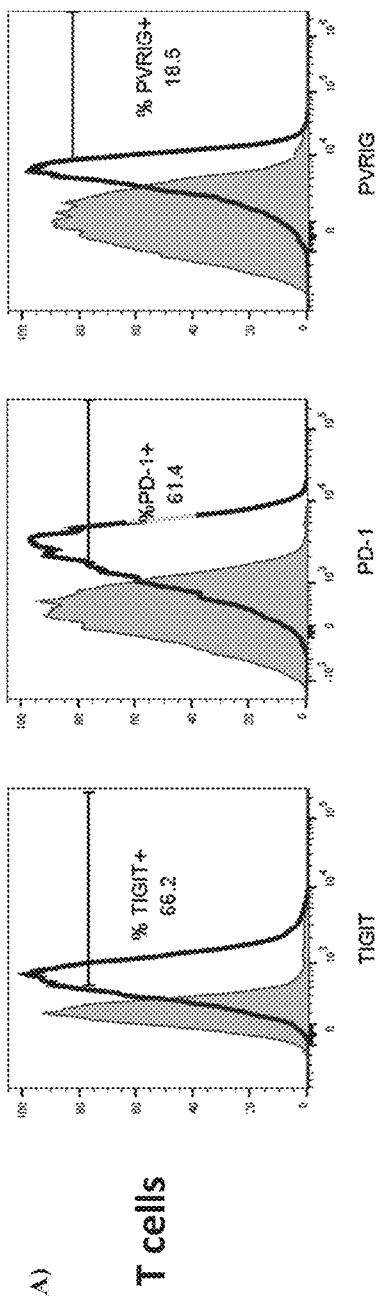
Figure 82B:
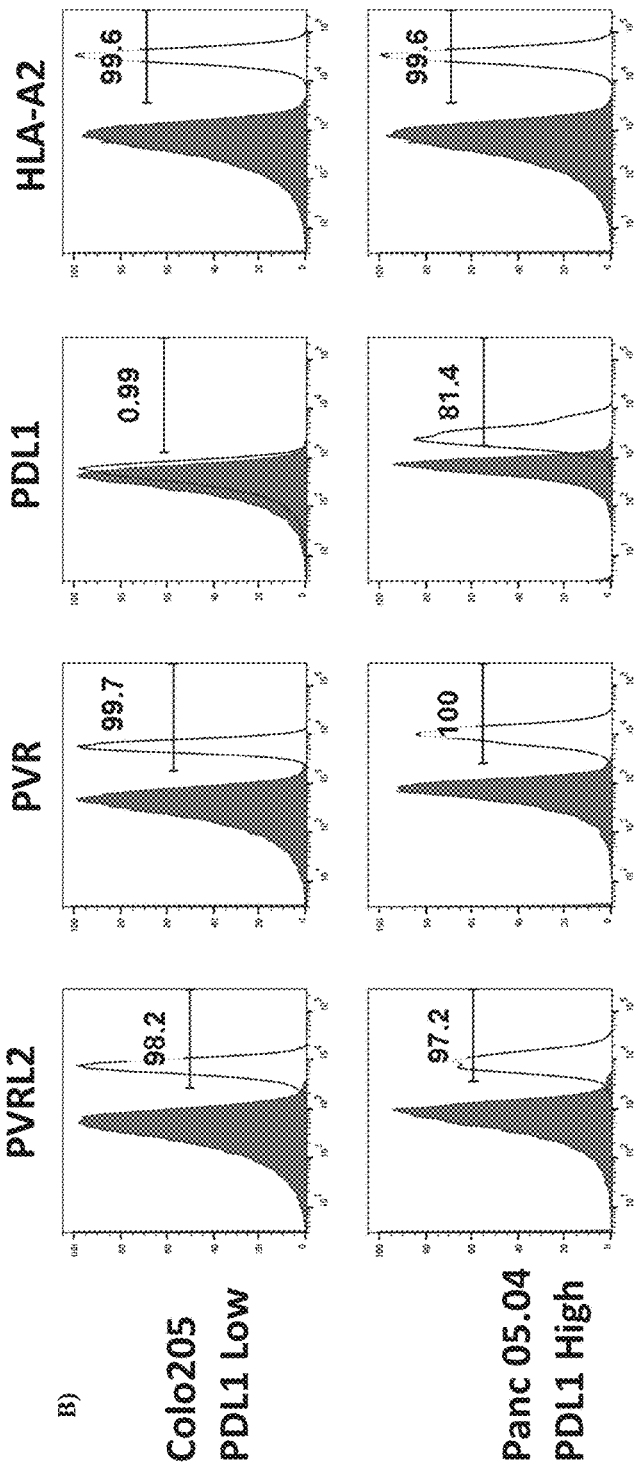
Figure 82C:
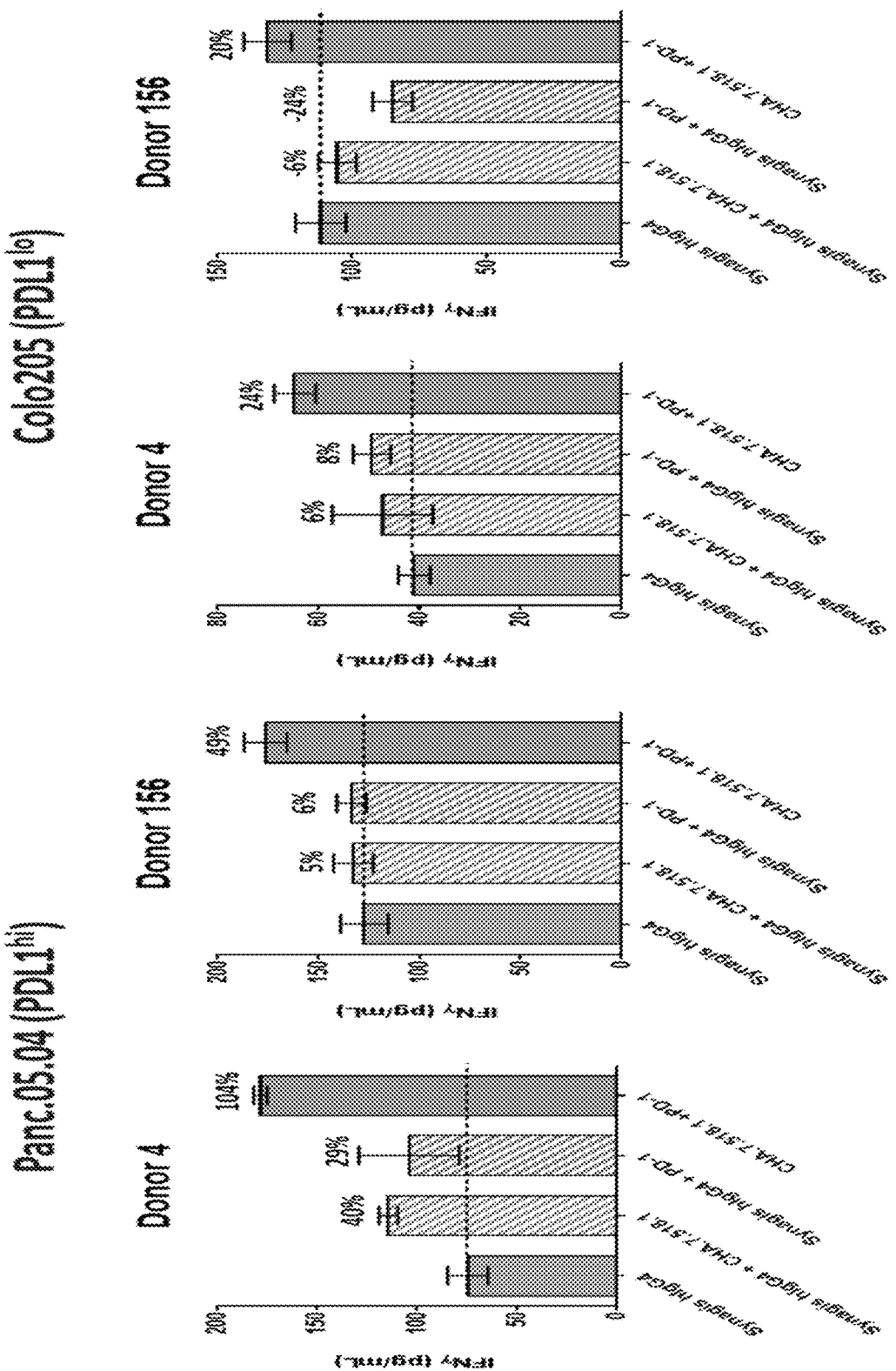

FIG. 82A-82C depict expression of PD-1/TIGIT/PVRIG on CD8 T cells and expression of PD-L1, PVR, PVRL2 on Colo205, Panc.05.04 cells. A) Expression of PVRIG, TIGIT, and PD-1 on CMVpp65 reactive T cells expanded with pp65 peptide with IL-2 and IL-7 for 10 days. Expression of PVRIG, TIGIT, and PD-1 on CMVpp65 reactive T cells is shown. B) Expression of PD-L1, PVR, and PVRL2 on Colo205 and Panc.05.04 cells is shown. C) CMVpp65 specific T cells were co-cultured with Colo205 and Panc.05.04 cells, CMVpp65 peptide, and the indicated antibodies at 10 mg/ml. IFN-γ concentration in the conditioned media was determined at 24 hrs. Average+Std Dev of triplicates is shown. % change in IFN-γ for each condition relative to hIgG4 is shown.

FIG. 83A-83H. PVRIG is expressed highest on cytotoxic lymphocyte subsets from human cancer. A) Expression of PVRIG on leukocyte cell subsets from 5-8 healthy donor PBMCs is shown. PVRIG expression is defined as the ratio of PVRIG MFI relative to isotype control MFI. B) Expression of PVRIG, TIGIT, CD96, and PD-1 on peripheral blood Tregs as compared to CD8 T cell subsets from 5 healthy donor PBMCs is shown. C) CMV pp65 specific T cells from 3 healthy donors were expanded in vitro with pp65 (495-503) peptide, IL-2 and IL-7 for up to 7 days. Expression of TIGIT (blue) and PVRIG (black) on HLA-A2/pp65 (495-503) tetramer positive cells is shown. D) Human T cells were cultured with allogeneic DCs and expression of TIGIT and PVRIG shown on CD4$^+$ T cells on day 0, 1, 2, and 7 post activation. E) Representative FACS plots showing expression of PVRIG (blue) compared to isotype control (red) on TILS (CD4 T cells, CD8 T cells, and NK cells) from a representative lung and kidney cancer. F) Co-expression of PVRIG, TIGIT, and PD-1 on CD4 and CD8 TILS from a lung cancer sample is shown. G) Expression of PVRIG on CD8$^+$ and CD4$^+$ TILS from dissociated human tumors of various cancer types is shown. Each dot represents a distinct tumor from an individual patient. H) Relative expression on CD8 TILs vs Treg TILS for PVRIG, TIGIT, and PD-1 from endometrial, kidney, and lung tumors was assessed. For each tumor, the fold expression on CD8 TILS was normalized to fold expression on Treg TILS and plotted. For A, B, C, G, and H, mean±SEM is shown by the error bars.

Figure 84A:
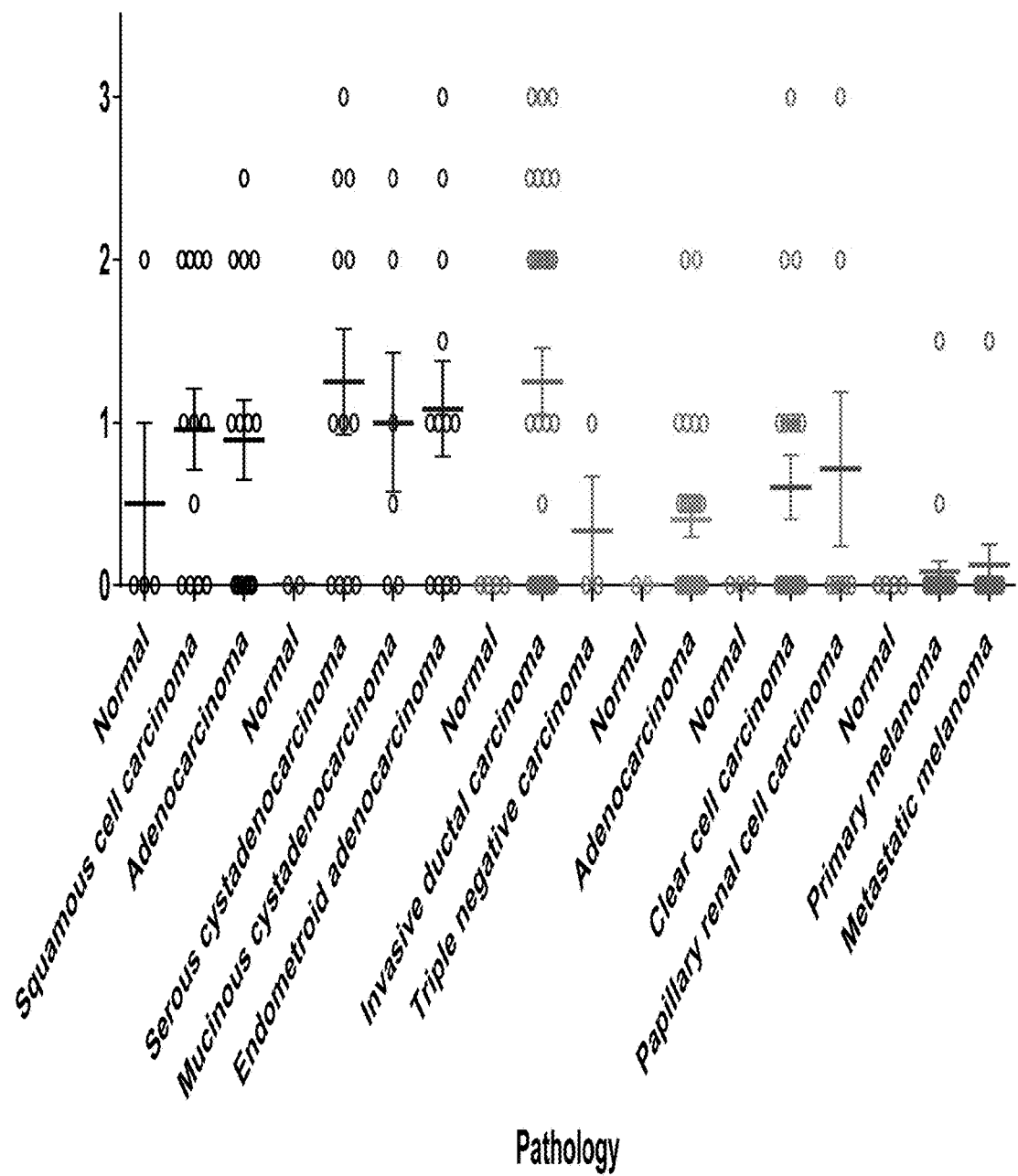

FIG. 84A-84F. PVRL2 expression is enhanced in the tumor microenvironment. A) PVRL2 expression was assessed by IHC on lung, ovarian/endometrial, breast, colon, kidney, and melanoma tumors. Bars depict mean±SEM. For each tumor, 2 cores were assessed by a pathologist and scored based on prevalence and intensity of membranous staining on tumor cells as described in the supplemental methods. For each tumor, the average score of 2 cores is shown. B) A representative melanoma tumor showing PVRL2 expression on tumor cells (arrow) and in the immune cells (*) in the stroma is shown. C) PVRL2 expression on a log2 scale from dissociated tumors determined by FACS on CD45$^-$, CD14$^+$ TAMs, and Lin$^-$CD14$^-$CD33$^{hi}$ mDC cell subsets is shown. Mean±SEM is shown for each cancer type. Dotted line represents no staining was observed. For each cell type, at least 100 events were required in order to be analyzed. D) Representative FACS plots for PVRL2 expression (blue) as compared to IgG (red) are shown for a lung cancer. E) For tumor samples where we were able to assess both PVRIG and PVRL2 expression, PVRIG expression on CD8$^+$ T cells is plotted versus PVRL2 expression on CD14$^+$ TAMS and CD45$^-$ cells for each tumor. Each dot represents an individual tumor sample. Red line represents a 2-fold expression of PVRIG or PVRL2 compared to IgG. The Table in FIG. 84F shows the prevalence of PVRL2 in various tumor samples.

FIG. 85A-85E. Distinct regulation of PVRL2 and PD-L1 on tumor cells. A) Expression of PD-L1 and PVRL2 was assessed by IHC on serial sections. Tumors samples from FIG. 84 A were grouped based on tissue type and expression of PVRL2 on PD-L1 negative and PD-L1 positive is shown. PD-L1 negative tumors were defined as no membranous staining on tumor or immune cells from either duplicate cores for a given tumor. PD-L1 positive staining was defined as membranous staining on at least 1 core of a tumor. Bars depict mean±SEM for each group. B, C) Representative expression of a PVRL2$^+$PD-L1$^-$ endometrial (B) tumor and a PVRL2$^+$PD-L1$^-$ lung (C) tumor. D) Immature BM-DCs were cultured with the indicated stimuli and PVR, PVRL2, and PD-L1 expression assessed by FACS on day 2 of culture. For each condition, expression was normalized to media only control condition. E) Expression of PVR, PVRL2, and PD-L1 on HT-29 cells treated with IFN-γ or media alone is shown. PD-L1 or PVRL2 is shown in blue and IgG isotype control staining is shown in red.

FIG. 86A-86I. CHA.7.518.1.H4(S241P) is a high affinity antibody that enhances T cell activation. A) Binding of CHA.7.518.1.H4(S241P) or IgG isotype control to HEK293 PVRIG or HEK293 parental cells by FACS is shown. FACS KD values are shown for the binding of CHA.7.518.1.H4(S241P) to HEK293 hPVRIG, HEK293 cPVRIG, and Jurkat cells. B) CHA.7.518.1.H4(S241P) disrupts the binding of PVRL2 Fc to HEK293 cells ectopically expressing PVRIG. Mean±Std Dev of triplicate values is shown. C) CHA.7.518.1.H4(S241P) blocks the binding of PVRIG Fc to HEK293 cells that endogenously express PVRL2. D) Human CD4 T cells were co-cultured with aAPC CHO cells expressing a cell surface bound anti-CD3 antibody and hPVRL2 in the presence of 10 µg/ml anti-PVRIG antibody and human IgG isotype control antibodies. The effect of anti-PVRIG Ab on proliferation of CD4 T cells isolated from 11 different donors is shown. Bars depicted mean±SEM. E) gp100 specific T cell lines (TIL-209, TIL-463) were co-cultured with CHO cells engineered to express HLA-A2 and PVRL2 along with 10 µg/ml anti-PVRIG or IgG isotype control antibody. IFN-γ and TNF-α production was tested at 24 hours post co-culture. Mean±Std Dev of triplicate values is shown. Percent change in IFN-γ and TNF-α for each condition relative to isotype control is depicted by the number above each bar F) Expression of PVR, PVRL2, and PD-L1 (red) relative to IgG (blue) on MEL624, Colo205, and Panc.05.04 cells is shown. For the T cells, expression of PVRIG, TIGIT, and PD-1 (red) relative to IgG (blue) on TIL-209 and TIL-463 gp100 specific T cells, and on CMVpp65 specific T cells is shown. To expand CMVpp65 reactive T cells, PBMCs were cultured with pp65 (495-503) peptide, IL-2, and IL-7 for 10 days. Expression of PVRIG, TIGIT, PD-1 is shown on HLA-A2/pp65 tetramer positive cells. G) gp100 specific T cells (TIL-209, TIL-463) expanded from TILS derived from melanoma tumors were co-cultured with MEL624 cells in the presence of 10 µg/ml of the indicated antibodies. IFN-γ concentration in the conditioned media was determined at 24 hrs. H, I) Expanded CMVpp65 specific T cells were co-cultured with Colo205 and Panc.05.04 cells, CMVpp65 peptide, and the indicated antibodies at 10 µg/ml. IFN-γ concentration in the conditioned media was determined at 24 hrs. For E, G, H, I, average±Std Dev of triplicates is shown. Percent change in IFN-γ for each condition relative to isotype control is depicted by the number above each bar.

FIG. 87A-87E. PVRIG deficient mice have increased T cell function. A) RNA expression of PVRIG as measured by qRT-PCR from purified mouse immune cell subsets was assessed. Relative expression to housekeeping was determined by @Ct method. B) pmel CD8$^+$ TCR transgenic T cells were activated with gp100 (25-33) and PVRIG and TIGIT RNA transcript levels assessed by qRT-PCR at the indicated time points. Graph shows mean±SEM of results from 5 different experiments. C) Spleens were harvested from PVRIG$^{-/-}$ and WT littermates and analyzed by flow cytometry for expression of PVRIG on NK, CD4$^+$ and CD8$^+$ T cells ("Resting" cells). In addition, CD3$^+$ T cells were isolated from splenocytes and activated for 11 days with anti-CD3/anti-CD28 beads. Following the activation, PVRIG expression on CD4$^+$ and CD8$^+$ T cells ("activated" cells) was analyzed by flow cytometry. Each dot represents cells derived from an individual mouse. D) WT and PVRIG$^{-/-}$ derived splenocytes were labeled with Cell Proliferation Dye eFluor450 and were cultured in the presence of Control-Fc (mouse IgG2a) or with mouse PVRL2 Fc. After 4 d of culture, cell division was analyzed by flow cytometry. Representative FACS plots from an experiment (left) and the summary of percentage inhibition by PVRL2 Fc (defined as % proliferation Control-Fc subtracted from % proliferation PVRL2 Fc) 3 independent experiments (right) are presented. * indicate p-value<0.05, paired student's t-test for the change in proliferation in the presence of PVRL2-FC relative to proliferation in the presence of protein control in WT versus PVRIG$^{-/-}$ T cells. E) pmel CD8$^+$ T cells derived from pmel PVRIG$^{-/-}$ or pmel PVRIG WT mice were activated for 11 days with their cognate peptide and IL2. Activated pmel CD8$^+$ cells were then co-cultured with B16-Db/gp100 cells for 18 hours and following the co-culture were evaluated for CD107 expression and for cytokine production. Four independent experiments are presented as indicated by each paired dot. * indicate p-value<0.05, Student's t-test comparing PVRIG$^{-/-}$ versus WT.

FIG. 88A-88H. PVRIG deficiency results in reduced tumor growth and increased CD8+ effector T cell mechanism. A) C57BL/6 WT or PVRIG$^{-/-}$ mice were subcutaneously injected with 5×10$^5$ MC38 cells. Tumor volumes were measured ×2 weekly. n=10 mice per group, Ave±SEM is shown, * Indicate p-value<0.05 by Student's unpaired t-test for WT mice versus PVRIG$^{-/-}$ mice (ANOVA). B) Individual tumor growth curves are shown. n=10 mice per group, one representative experiment is shown (n=2). C) C57BL/6 WT or PVRIG$^{-/-}$ mice were subcutaneously injected with 5×10$^5$ MC38 cells. At day 14 post-inoculation, mice were treated with anti-PD-L1, ×2 weekly for 2 weeks. Tumor volumes were measured ×2 weekly. n=10 mice per group, Ave±SEM is shown, p-value=0.052 by Student's unpaired t-test for WT mice versus PVRIG$^{-/-}$ mice, both treated with anti-PD-L1. D) Individual tumor growth curves are shown. One representative experiment is shown (n=2). E-H) In separate duplicate experiments, tumors were harvested on day 18 after mice had received 2 doses of anti-PD-L1 or the relevant isotype control. Dissociated tumors were enriched for CD45$^+$ cells prior to stimulation for 4 hours with PMA and Ionomycin in the presence of Brefeldin A. Graphs illustrate the total numbers per mg tumor tissue of CD45$^+$ immune cells, CD8$^+$ T cells and Interferon-γ-producing CD8$^+$ T cells from isotype-treated wild-type and PVRIG$^{-/-}$ mice (E) and from anti-PD-L1-treated wild-type and PVRIG$^{-/-}$ mice (F). G-H) Frequency of CD8$^+$ IFN-γ$^+$ TNF-α$^+$ effector cells in tumor-draining lymph nodes from isotype- and anti-PD-L1-treated PVRIG$^{-/-}$ mice, relative to their corresponding wild-type cohort is shown. For E-H, Ave±SEM is shown and p values from a Student's unpaired t-test is shown.

FIG. 89A-89F. Antagonistic anti-PVRIG antibodies synergistically inhibit tumor grown in combination of PD-1 inhibitors or TIGIT genetic deficiency. A) Binding of mPVRL2 Fc fusion protein to mPVRIG HEK293 engineered cells that were pre-incubated with serial dilutions of anti-mPVRIG mAb or IgG isotype control Ab is shown. B) BALB/c mice were subcutaneously injected with 5×10$^5$ CT26 cells. On day 14 post inoculation, mice were sacrificed and spleen, draining lymph nodes and tumors were harvested. Cells were analyzed by flow cytometry for expression of PVRIG on CD3$^+$CD4$^+$ T cells, CD3$^+$CD8$^+$ T cells, CD3$^-$CD49b$^+$ NK cells, CD11b$^+$ Gr-1$^+$ Myeloid-Derived-Suppressor Cells (MDSC) and CD11b$^+$F4/80$^+$ macrophages. C, D) BALB/c mice were subcutaneously injected with 5×10$^5$ CT26 cells. At day 7 post inoculation mice were treated with anti-PD-L1 and/or anti-PVRIG Ab, 2× weekly for 3 weeks (arrows indicate Ab treatment). C) Tumor volumes are shown. *** indicate p-value<0.001 (ANOVA) for aPD-L1+Rat IgG2b compared to αPD-L1+αPVRIG treated groups. Arrows indicate when antibodies were dosed. D. Survival analysis of complete responder's mice. * indicate p value<0.05 (Log-rank test) for αPD-L1+Rat IgG2b compared to αPD-L1+αPVRIG treated groups. One representative study of 3 studies are shown. E. C57BL/6 or TIGIT mice were subcutaneously injected with 1×10$^5$ B16/Db-hmgp100 cells. Mice were treated 2× weekly for 3 weeks with the designated mAb starting on the day of inoculation (day 0). E. Tumor volumes were measured 2× weekly and average±SEM is shown. Tumor growth inhibition as measured at indicated days compared to control WT+mIgG1 isotype control. *** indicate p-value<0.001 for TIGIT$^{-/-}$+ αPVRIG compared to WT+mIgG1 isotype control. Arrows indicate when antibodies were dosed. F. Individual tumor growth curves for each mouse is shown. One representative experiment out of 2 performed is shown.

FIG. 90A-90F. PVRIG is expressed on T and NK cells of TILS in human cancer. A) Expression of PVRIG, TIGIT, CD96, and PD-1 on CD4 T cell subsets from healthy donor PBMCs is shown. Mean±SEM is shown. B) Human T cells were co-cultured with allogeneic PBMCs and expression of PVRIG protein on CD4 and CD8 T cells shown (top). C) Tumors were dissociated and single cells were activated with anti-CD3 and anti-CD28. Expression of PVRIG (blue) relative to IgG isotype control (red) was assessed on day 0 (directly ex vivo) and day 5 post activation. D) Expression of PVRIG on NK cells from dissociated human tumors is shown. Each dot represents a distinct tumor from an individual patient. Mean±95% confidence internal is shown. D) Dissociated tumor cells were activated with anti-CD3 and anti-CD28 beads for 5 days. Expression of PVRIG (blue) relative to IgG control (red) on CD4 and CD8 T cells on day 0 directly ex vivo and on day 5 post activation is shown for 2 dissociated tumor samples. E) Expression of PVRIG was assessed on CD4 and CD8 T cells from dissociated tumors and from dissociated donor-matched normal adjacent tissue. Each line represents matched tissues obtained from an individual patient. A paired student's t-test was performed. F) A correlation analysis of the magnitude of PVRIG, TIGIT, and PD-1 fold expression relative to IgG isotype control on CD4 and CD8 T cells from tumors is shown. Each dot represents an individual tumor sample. A Spearman's correlation coefficient and p value are shown.

Figure 91:
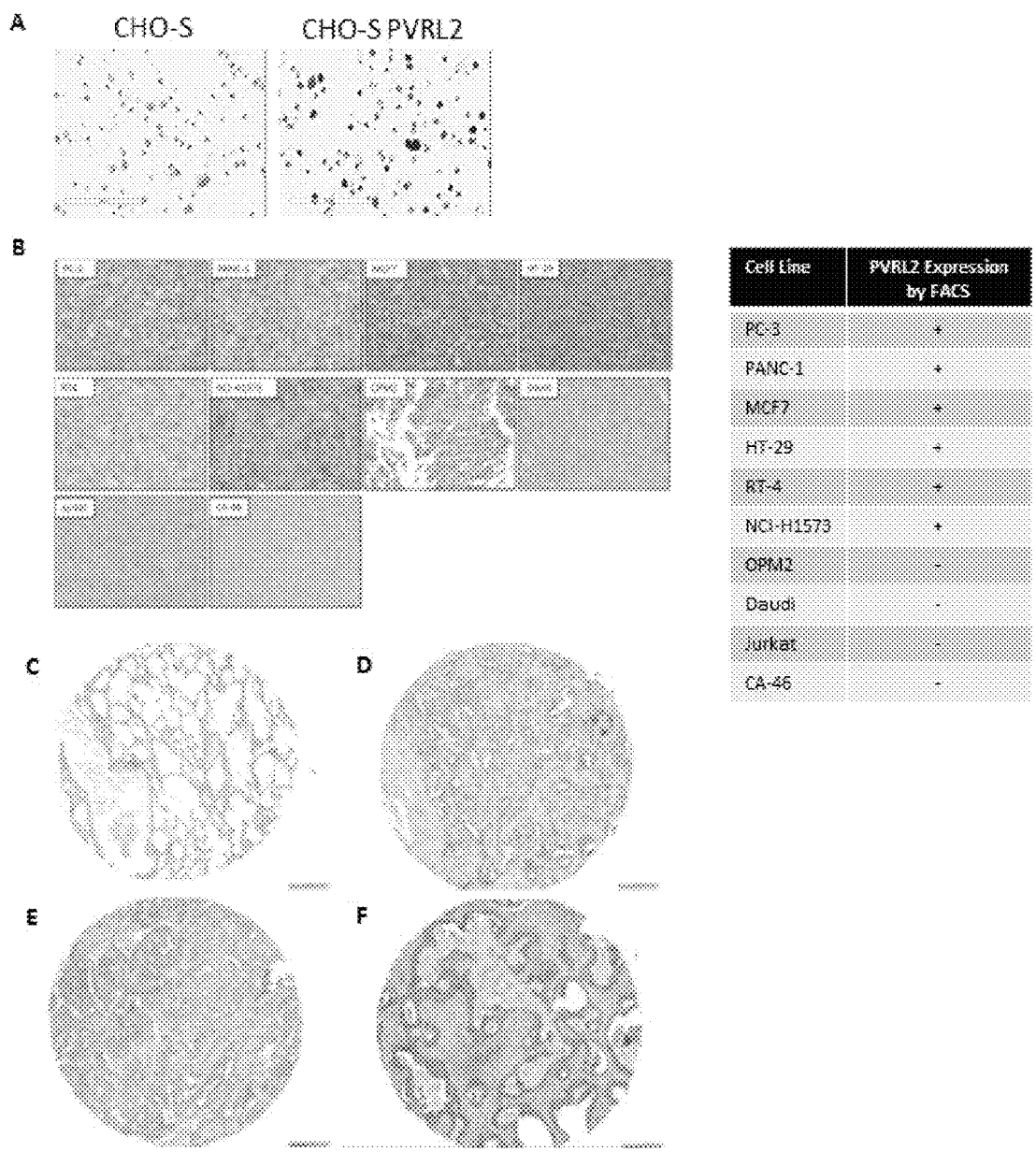

FIG. 91. Expression of PVRL2 is enhanced in colon, skin, and breast cancers. A) Photomicrographs showing the binding of Sigma anti human PVRL2 antibody to FFPE sections of positive cells, CHO-S human PVRL2 (right) compare to negative cells, CHO-S (left), following antigen retrieval at pH9. B) Anti-PVRL2 antibody was tested on a panel of PVRL2$^+$ (HT29, MCF7, PC3, PANC1, RT4, NCI-H1573) and PVRL2$^-$ (Jurkat, OPM2, Daudi, CA46) cell lines. C-F) Example expression of PVRL2 in lung normal and cancer tissues. C) Normal tissue showing no staining. D) Lung Adenocarcinoma showing partial positive staining. E) Lung adenocarcinoma showing positive staining. F) Lung adenocarcinoma showing strong positive staining.

FIG. 92. PVRL2 is upregulated on TAMs and CD45⁻ cells in the tumor as compared to normal adjacent tissue. Expression of PVRL2 on CD45⁻ cells and TAMs from donor matched tumor and normal adjacent tissue is shown. A paired student's t-test p value is shown.

Figure 93A:
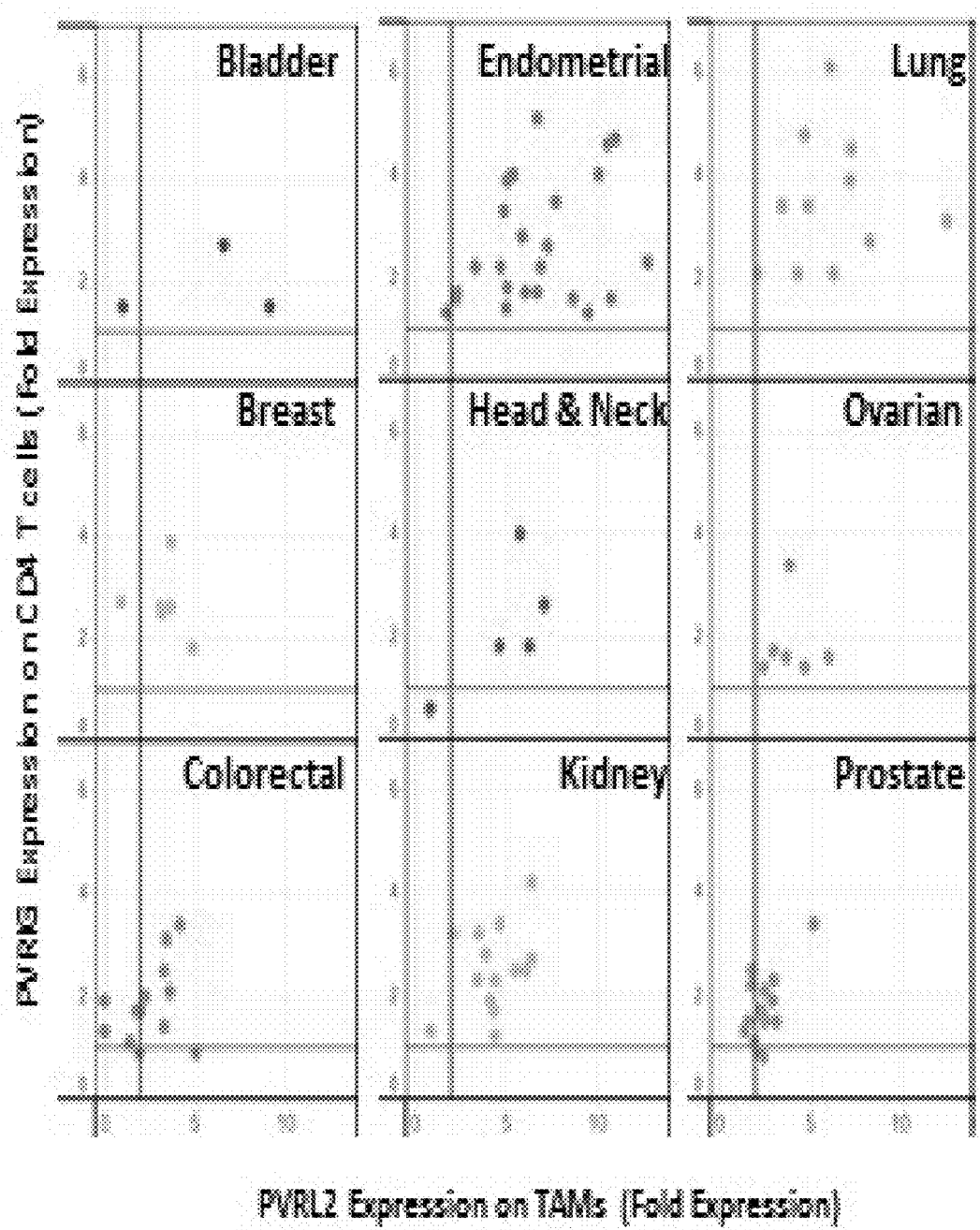
Figure 93B:
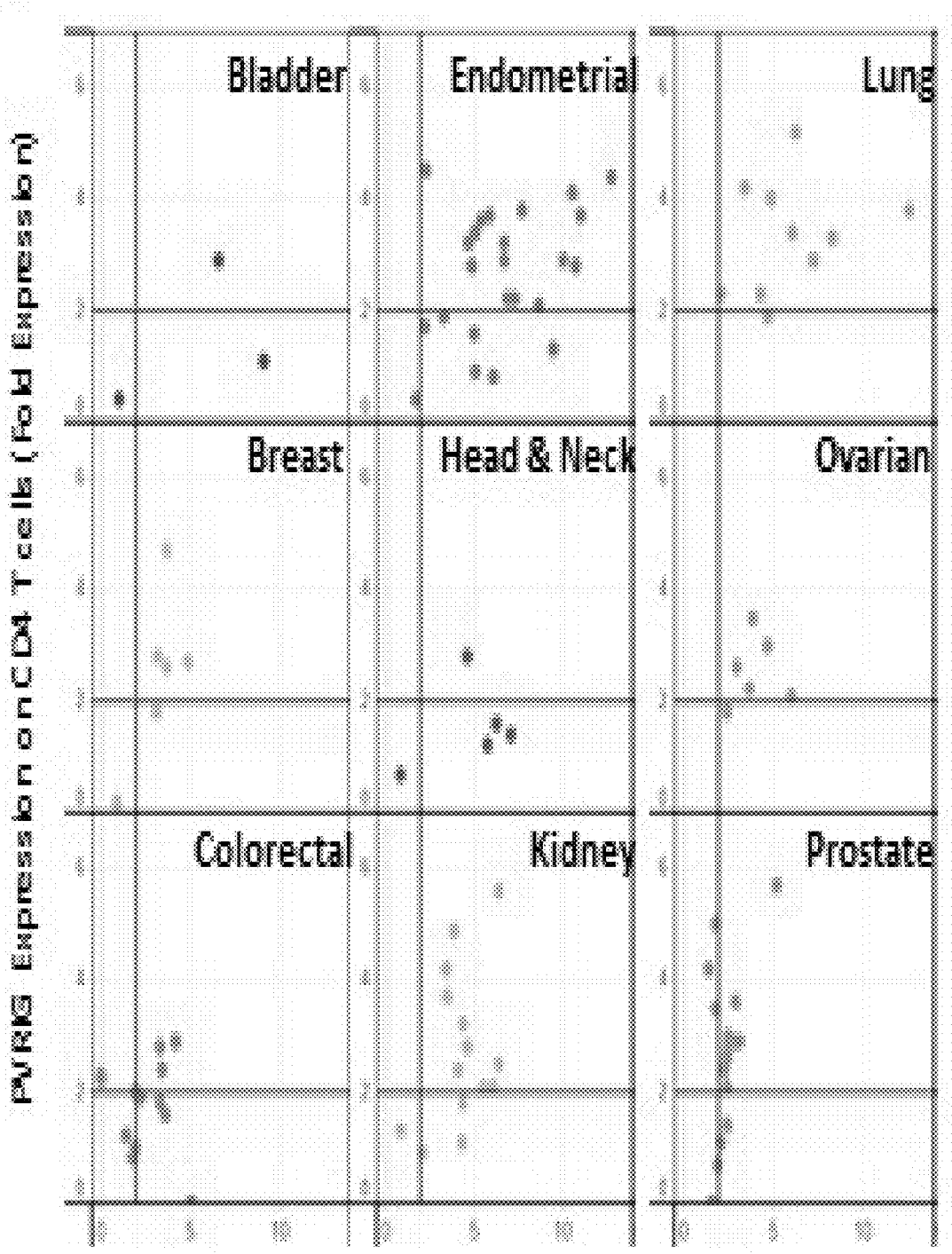

FIGS. 93A and 93B. PVRIG and PVRL2 are co-expressed in the same tumor sample. PVRIG expression on CD4 T cells (A) and NK cells (B) is plotted against PVRL2 expression on TAMS for an individual tumor.

FIG. 94A-94D. Activity of CHA.7.518.1.H4(S241P) on human T cells. A) Expression of PVRIG on CD4 T cells activated with CHO cells expressing cell surface bound anti-CD3 and PVRL2. B) Expression of HLA-A2, B-2m, and PVRL2 are shown on CHO-S parental and engineered CHO-S cell lines. Fold expression relative to isotype is depicted by the number. C) CHO cells ectopically expressing cell surface bound anti-CD3 and PVRL2 were co-cultured with purified CD8 T cells in the presence of varying concentrations of anti-PVRIG Ab or relevant IgG control. % Proliferation is shown. Each dot represents an average of triplicate values. D) CHO cells ectopically expression HLA-A2/B2m and PVRL2 were co-cultured with 2 gp100 specific T cell lines (TIL F4, TIL 209) in the presence of 1 ug/ml gp100 and varying concentrations of anti-PVRIG antibody or relevant IgG control. TNF-α concentrations on day 3 of co-culture is down. Each value represents an average of triplicates.

FIG. 95A-95J. Characterization of mPVRIG binding interactions and a surrogate anti-mPVRIG antibody. A, B) Binding of mPVRIG to mPVRL2 was assessed by surface plasmon resonance. C) Soluble receptor Fc or control proteins were incubated in a dose response with immobilized mPVRL2 HIS in an ELISA format. Bound receptor Fc is shown. D) Soluble PVRL2 HIS protein was incubated in a dose response with PVRIG Fc or DNAM Fc coated plates. E) Binding of mPVRIG Fc or control Fc fusion protein to B16-F10 cell line transfected with mPVRL2 siRNA, mPVRsRNA, or scrambled siRNA transfection is shown. F) Affinity characterization of rat anti-mouse PVRIG mAb was performed by examining the binding of anti-mPVRIG to HEK293 cells overexpressing mPVRIG. G) Affinity characterization of rat anti-mouse PVRIG mAb was performed by examining the of anti-mPVRIG to D10.G4.1 cell line endogenously expressing mPVRIG vs isotype control rat IgG is shown. H) Binding of anti-mPVRIG to D10.G4.1 cells transfected with mouse PVRIG-siRNA (green histogram) vs scr siRNA (orange histogram). I) Binding of mPVRIG Fc pre-incubated with anti-mPVRIG Ab to B16-F10 cells, which endogenously express PVRL2

FIG. 96. Generation of transgenic PVRIG and TIGIT knockout mice. The PVRIG conditional knockout and Tigit knockout mouse lines were generated by Ozgene Pty Ltd (Bentley W A, Australia). A) The targeting construct in which PVRIG exons 1 to 4 were floxed was electroporated into a C57BL/6 ES cell line, Bruce4 (Koentgen et al., Int Immunol 5: 957-964, 1993). B) The targeting construct in which the coding region of Tigit exon 1 (including the ATG) and exons 2 and 3 were replaced with an FRT-flanked neo cassette was electroporated into a C57BL/6 ES cell line, Bruce4. Homologous recombinant ES cell clones were identified by Southern hybridization and injected into goGermline blastocysts (Koentgen et al., genesis 54: 326-333, 2016). Male chimeric mice were obtained and crossed to C57BL/6J females to establish heterozygous germline offspring on C57BL/6 background. The germline mice were crossed to a ubiquitous FLP C57BL/6 mouse line to remove the FRT flanked selectable marker cassette and generate the conditional or knockout alleles (for PVRIG and Tigit, respectively). For PVRIG knockout, mice were further crossed to a ubiquitous Cre C57BL/6 mouse line to remove the loxP flanked exons and generate the knockout allele.

FIG. 97A-97I. PVRIG knockout mice are immune-phenotypically similar to wild-type mice. Mice (n=5 per wild-type and PVRIG knockout cohorts) were euthanized prior to venous blood being collected in anti-coagulant-coated tubes and harvesting of organs. Single cells were recovered from freshly harvested bone marrow, thymus, spleen, cutaneous and mesenteric lymph nodes. Cells were stained with fluorochrome-conjugated surface marker antibodies and acquired on a BD LSR Fortessa flow cytometer. Panels illustrate comparable frequencies of myeloid cells (A), dendritic cells (B), B cells (C), T cells (D), CD4 T cells (E), CD8 T cells (F), and NK cells (G) across lymphoid tissue types. (H-I) Whole venous blood was run on a Hemavet 950 veterinary hematology system to compare differential counts and frequencies of blood cell subsets from wild-type and PVRIG deficient mice.

FIG. 98A-98I. Increased T cell effector function in PVRIG$^{-/-}$ mice treated with anti-PDL1 compared to WT with anti-PD-L1. MC38 tumors were inoculated into WT or PVRIG$^{-/-}$ mice and were subsequently treated with anti-PD-L1 or rat IgG2b isotype control. On day 18, CD45+ tumor infiltrating lymphocytes were purified from tumors, RNA extracted, and transcript profiling performed. Several T cell related genes are shown, with each dot representing an individual mouse. Student's t test p values are shown.

FIG. 99. Anti-TIGIT and anti-PVRIG antibodies induce tumor cell killing. An in vitro co-culture assay with human CMV-specific CD8+ T cells expanded was utilized to assess the effect of the benchmark anti-TIGIT antibody and CHA.7.518.1.H4(S241P) on antigen-specific tumor cell killing. HLA-A2+ target cell lines used in the assay were the Mel624 (A) and Panc05.04 (B). Synagis hIgG4 is the isotype control antibody. Luciferase activity in the target cells was measured with the Bio-Glo luciferase substrate. Representative data (n≥2) shows the percent specific killing (mean+/−standard deviation) of Mel624 or Panc05.04 cells after a 16-hour co-culture with human CMV-specific CD8+ T cells from three different donors.

Figure 100:
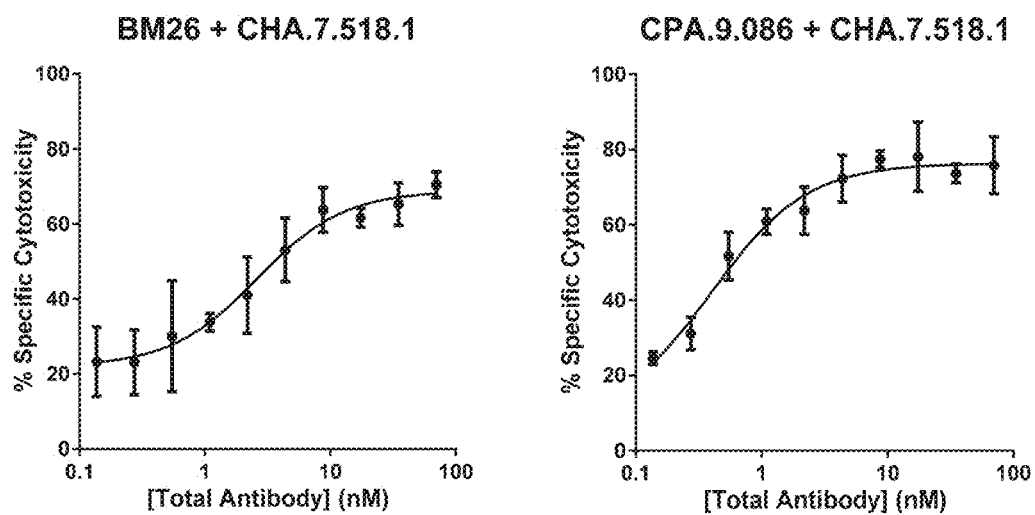

FIG. 100. Dose-dependent tumor cell killing of anti-TIGIT antibodies with CHA.7.518.1.H4(S241P). An in vitro co-culture assay with human CMV-specific CD8+ T cells was utilized to assess the effect of two different anti-TIGIT antibodies, BM26 and CPA.9.086 when combined with CHA.7.518.1.H4(S241P) on antigen-specific Mel624 cell killing. Luciferase activity in the target cells was measured with the Bio-Glo luciferase substrate. Representative data (n≥2) shows the percent specific killing (mean+/−standard deviation) of Mel624 cells after a 16-hour co-culture with human CMV-specific CD8+ T cells from one donor.

FIG. 101. CPA.9.086 CDR sequences, IMGT and Kabat numbering.

FIG. 102. Anti-TIGIT hIgG4+CHA.7.518.1.H4(S241P) combination induces tumor cell killing. Co-culture of CMV-reactive CD8+ T cells with Mel624 PVR, PVRL2 & luciferase OE Single dose of 10 μg/ml aTIGIT Ab and 10 μg/ml CHA.7.518.1.H4(S241P) with CMV-reactive donor 4, while dose titration starting at 0.5 μg/ml aTIGIT Ab and 10 μg/ml CHA.7.518.1.H4(S241P) with CMV-reactive donor 156.

V. DETAILED DESCRIPTION OF THE INVENTION

A. Overview

The present invention provides a number of useful antibodies, for use alone or in combination, for treatment of cancer. Cancer can be considered as an inability of the patient to recognize and eliminate cancerous cells. In many instances, these transformed (e.g. cancerous) cells counteract immunosurveillance. There are natural control mechanisms that limit T-cell activation in the body to prevent unrestrained T-cell activity, which can be exploited by cancerous cells to evade or suppress the immune response. Restoring the capacity of immune effector cells—especially T cells—to recognize and eliminate cancer is the goal of immunotherapy. The field of immuno-oncology, sometimes referred to as "immunotherapy" is rapidly evolving, with several recent approvals of T cell checkpoint inhibitory antibodies such as Yervoy, Keytruda and Opdivo. These antibodies are generally referred to as "checkpoint inhibitors" because they block normally negative regulators of T cell immunity. It is generally understood that a variety of immunomodulatory signals, both costimulatory and coinhibitory, can be used to orchestrate an optimal antigen-specific immune response. Generally, these antibodies bind to checkpoint inhibitor proteins such as CTLA-4 or PD-1, which under normal circumstances prevent or suppress activation of cytotoxic T cells (CTLs). By inhibiting the checkpoint protein, for example through the use of antibodies that bind these proteins, an increased T cell response against tumors can be achieved. That is, these cancer checkpoint proteins suppress the immune response; when the proteins are blocked, for example using antibodies to the checkpoint protein, the immune system is activated, leading to immune stimulation, resulting in treatment of conditions such as cancer and infectious disease.

The present invention is directed to the use of antibodies to additional checkpoint proteins, PVRIG and TIGIT. PVRIG is expressed on the cell surface of NK and T-cells and shares several similarities to other known immune checkpoints. The identification and methods used to show that PVRIG is a checkpoint receptor are discussed in WO2016/134333, expressly incorporated herein by reference. Antibodies to human PVRIG that block the interaction and/or binding of PVLR2 are provided herein. When PVRIG is bound by its ligand (PVRL2), an inhibitory signal is elicited which acts to attenuate the immune response of NK and T-cells against a target cell (i.e. analogous to PD-1/PDL1). Blocking the binding of PVRL2 to PVRIG shuts-off this inhibitory signal of PVRIG and as a result modulates the immune response of NK and T-cells. Utilizing an antibody against PVRIG that blocks binding to PVRL2 is a therapeutic approach that enhances the killing of cancer cells by NK and T-cells. Blocking antibodies have been generated which bind PVRIG and block the binding of its ligand, PVRL2. Anti-PVRIG antibodies in combination with other checkpoint inhibitor antibodies such as PD-1 are provided.

Similarly, TIGIT has been shown to also have attributes of a checkpoint receptor, and the present invention provides anti-TIGIT antibodies that block the interaction and/or binding of TIGIT to PVR are provided. When TIGIT is bound by its ligand (PVR), an inhibitory signal is elicited which acts to attenuate the immune response of NK and T-cells against a target cell (i.e. analogous to PD-1/PDL1). Blocking the binding of PVR to TIGIT shuts-off this inhibitory signal of TIGIT and as a result modulates the immune response of NK and T-cells. Utilizing an antibody against TIGIT that blocks binding to PVR is a therapeutic approach that enhances the killing of cancer cells by NK and T-cells. Blocking antibodies have been generated which bind TIGIT and block the binding of its ligand, PVR. Anti-TIGIT antibodies in combination with other checkpoint inhibitor antibodies such as PD-1 are provided.

Additionally, the invention provides combinations of anti-PVRIG and anti-TIGIT antibodies for use in the treatment of cancer.

B. Definitions

In order that the application may be more completely understood, several definitions are set forth below. Such definitions are meant to encompass grammatical equivalents.

By "ablation" herein is meant a decrease or removal of activity. In some embodiments, it is useful to remove activity from the constant domains of the antibodies. Thus, for example, "ablating FcγR binding" means the Fc region amino acid variant has less than 50% starting binding as compared to an Fc region not containing the specific variant, with less than 70-80-90-95-98% loss of activity being preferred, and in general, with the activity being below the level of detectable binding in a Biacore assay. As shown in FIG. 50, one ablation variant in the IgG1 constant region is the N297A variant, which removes the native glycosylation site and significantly reduces the FcγRIIIa binding and thus reduces the antibody dependent cell-mediated cytotoxicity (ADCC).

By "antigen binding domain" or "ABD" herein is meant a set of six Complementary Determining Regions (CDRs) that, when present as part of a polypeptide sequence, specifically binds a target antigen as discussed herein. Thus, a "TIGIT antigen binding domain" binds TIGIT antigen (the sequence of which is shown in FIG. 51) as outlined herein. Similarly, a "PVRIG antibody binding domain" binds PVRIG antigen (the sequence of which is shown in FIG. 1) as outlined herein. As is known in the art, these CDRs are generally present as a first set of variable heavy CDRs (vhCDRs or $V_H$CDRs) and a second set of variable light CDRs (vlCDRs or $V_L$CDRs), each comprising three CDRs: vhCDR1, vhCDR2, vhCDR3 for the heavy chain and vlCDR1, vlCDR2 and vlCDR3 for the light. The CDRs are present in the variable heavy and variable light domains, respectively, and together form an Fv region. Thus, in some cases, the six CDRs of the antigen binding domain are contributed by a variable heavy and variable light chain. In a "Fab" format, the set of 6 CDRs are contributed by two different polypeptide sequences, the variable heavy domain (vh or $V_H$; containing the vhCDR1, vhCDR2 and vhCDR3) and the variable light domain (vl or $V_L$; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain).

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution N297A refers to a variant polypeptide, in this case an Fc variant, in which the asparagine at position 297 is replaced with alanine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, −233E or 233E designates an insertion of glutamic acid after position 233 and before position 234. Additionally, −233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233- or E233#, E233( ) or E233del designates a deletion of glutamic acid at position 233. Additionally, EDA233- or EDA233# designates a deletion of the sequence GluAspAla that begins at position 233.

By "variant protein" or "protein variant", or "variant" as used herein is meant a protein that differs from that of a parent protein by virtue of at least one amino acid modification. Protein variant may refer to the protein itself, a composition comprising the protein, or the amino sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide, for example an Fc parent polypeptide, is a human wild type sequence, such as the Fc region from IgG1, IgG2, IgG3 or IgG4, although human sequences with variants can also serve as "parent polypeptides". The protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain. The Fc variants of the present invention are defined according to the amino acid modifications that compose them. Thus, for example, S241P or S228P is a hinge variant with the substitution proline at position 228 relative to the parent IgG4 hinge polypeptide, wherein the numbering S228P is according to the EU index and the S241P is the Kabat numbering. The EU index or EU index as in Kabat or EU numbering scheme refers to the numbering of the EU antibody (Edelman et al., 1969, Proc Natl Acad Sci USA 63:78-85, hereby entirely incorporated by reference.) The modification can be an addition, deletion, or substitution. Substitutions can include naturally occurring amino acids and, in some cases, synthetic amino acids. Examples include U.S. Pat. No. 6,586,207; WO 98/48032; WO 03/073238; US2004-0214988A1; WO 05/35727A2; WO 05/74524A2; J. W. Chin et al., (2002), Journal of the American Chemical Society 124: 9026-9027; J. W. Chin, & P. G. Schultz, (2002), ChemBioChem 11:1135-1137; J. W. Chin, et al., (2002), PICAS United States of America 99:11020-11024; and, L. Wang, & P. G. Schultz, (2002), Chem. 1-10, all entirely incorporated by reference.

As used herein, "protein" herein is meant at least two covalently attached amino acids, which includes proteins, polypeptides, oligopeptides and peptides. The peptidyl group may comprise naturally occurring amino acids and peptide bonds, or synthetic peptidomimetic structures, i.e. "analogs", such as peptoids (see Simon et al., PNAS USA 89(20):9367 (1992), entirely incorporated by reference). The amino acids may either be naturally occurring or synthetic (e.g. not an amino acid that is coded for by DNA); as will be appreciated by those in the art. For example, homophenylalanine, citrulline, ornithine and norleucine are considered synthetic amino acids for the purposes of the invention, and both D- and L- (R or S) configured amino acids may be utilized. The variants of the present invention may comprise modifications that include the use of synthetic amino acids incorporated using, for example, the technologies developed by Schultz and colleagues, including but not limited to methods described by Cropp & Shultz, 2004, Trends Genet. 20(12):625-30, Anderson et al., 2004, Proc Natl Acad Sci USA 101 (2):7566-71, Zhang et al., 2003, 303(5656):371-3, and Chin et al., 2003, Science 301(5635): 964-7, all entirely incorporated by reference. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "Fab" or "Fab region" as used herein is meant the polypeptide that comprises the VH, CH1, VL, and CL immunoglobulin domains. Fab may refer to this region in isolation, or this region in the context of a full length antibody or antibody fragment.

By "Fv" or "Fv fragment" or "Fv region" as used herein is meant a polypeptide that comprises the VL and VH domains of a single antibody. As will be appreciated by those in the art, these generally are made up of two chains.

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (vh-linker-vl or vl-linker-vh). In general, the linker is a scFv linker as is generally known in the art, with the linker peptide predominantly including the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n, (GGGGS)n, and (GGGS)n, where n is an integer of at least one (and generally from 3 to 4), glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers, that is may find use as linkers.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification. Similarly, because IgG1 has a proline at position 241 and IgG4 has a serine there, an IgG4 molecule with a S241P is considered an IgG subclass modification. Note that subclass modifications are considered amino acid substitutions herein.

By "non-naturally occurring modification" as used herein is meant an amino acid modification that is not isotopic. For example, because none of the IgGs comprise AN asparagine at position 297, the substitution N297A in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below.

By "Fc" or "Fc region" or "Fc domain" as used herein is meant the polypeptide comprising the constant region of an antibody excluding the first constant region immunoglobulin domain and in some cases, part of the hinge. Thus Fc refers to the last two constant region immunoglobulin domains of IgA, IgD, and IgG, the last three constant region immunoglobulin domains of IgE and IgM, and the flexible hinge N-terminal to these domains. For IgA and IgM, Fc may include the J chain. For IgG, the Fc domain comprises immunoglobulin domains Cγ2 and Cγ3 (Cγ2 and Cγ3) and the lower hinge region between Cγ1 (Cγ1) and Cγ2 (Cγ2). Although the boundaries of the Fc region may vary, the human IgG heavy chain Fc region is usually defined to include residues C226 or P230 to its carboxyl-terminus, wherein the numbering is according to the EU index as in Kabat. In some embodiments, as is more fully described below, amino acid modifications are made to the Fc region, for example to alter binding to one or more FcγR receptors or to the FcRn receptor.

By "heavy constant region" herein is meant the CH1-hinge-CH2-CH3 portion of an antibody.

By "position" as used herein is meant a location in the sequence of a protein. Positions may be numbered sequentially, or according to an established format, for example the EU index for antibody numbering.

By "target antigen" as used herein is meant the molecule that is bound specifically by the variable region of a given antibody. In the present case, one target antigen of interest herein is TIGIT, usually human TIGIT and optionally cyno TIGIT, as defined below. Another target antigen of interest is PVRIG, usually human PVRIG and optionally cyno PVRIG, as defined below.

By "target cell" as used herein is meant a cell that expresses a target antigen.

By "variable region" as used herein is meant the region of an immunoglobulin that comprises one or more Ig domains substantially encoded by any of the Vκ (V.kappa), Vλ (V.lamda), and/or VH genes that make up the kappa, lambda, and heavy chain immunoglobulin genetic loci respectively.

By "wild type or WT" herein is meant an amino acid sequence or a nucleotide sequence that is found in nature, including allelic variations. A WT protein has an amino acid sequence or a nucleotide sequence that has not been intentionally modified.

The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities. "Recombinant" means the antibodies are generated using recombinant nucleic acid techniques in exogeneous host cells.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-9}$ M, at least about $10^{-10}$ M, at least about $10^{-11}$ M, at least about $10^{-12}$ M, at least about $10^{-13}$ M, at least about $10^{-14}$ M, at least about $10^{-15}$ M, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using surface plasmon resonance (e.g. Biacore assay) and flow cytometry with antigen-expressing cells.

C. Sequences

The sequence listing provides a number of sequences based on the Format of FIG. 53; reference is made to FIG. 4 of U.S. Ser. No. 62/513,916 (hereby expressly incorporated by reference) as a guide to the labeling of the sequences. The variable heavy domain is labeled with the identifier (e.g. "CPA.0.86"), with the next sequence following the format of FIG. 53 of the present specification (identical to the format of FIG. 4, referenced above), in that the next sequence identifier is to the vhCDR1, the next to vhCDR2, with vhCDR3, the full length heavy chain, the variable light domain, vlCDR1, vlCDR2, vlCDR3 and the full length light chain. Thus an individual antibody has 10 associated sequence identifiers.). Included in the sequence listing are the sequences of BM26 mouse IgG1 (BM26-M1) (WO2016/028656A1, Clone 31C6) and BM29 mouse IgG1 (BM29-M1) (US2016/0176963A1, Clone 22G2). Unless noted, the full length HC sequences of the TIGIT antibodies are in the H4(S241P) format.

D. PVRIG Proteins

The present invention provides antibodies that specifically bind to PVRIG proteins and prevent activation by its ligand protein, PVRL2, a human plasma membrane glycoprotein. PVRIG, also called Poliovirus Receptor Related Immunoglobulin Domain Containing Protein, Q6DKI7 or C7orf15, relates to amino acid and nucleic acid sequences shown in RefSeq accession identifier NP_076975, shown in FIG. 1. The sequence of human Poliovirus receptor-related 2 protein (PVLR2, also known as nectin-2, CD112 or herpesvirus entry mediator B, (HVEB)), the binding partner of PVRIG (as shown in Example 5 of US Publication 2016/0244521), is shown in FIG. 2. The antibodies of the invention are specific for the PVRIG extracellular domain such that the binding of PVRIG and PVLR2 is blocked.

PVRIG is a transmembrane domain protein of 326 amino acids in length, with a signal peptide (spanning from amino acid 1 to 40), an extracellular domain (spanning from amino acid 41 to 171), a transmembrane domain (spanning from amino acid 172 to 190) and a cytoplasmic domain (spanning from amino acid 191 to 326). There are two methionines that can be start codons, but the mature proteins are identical.

Accordingly, as used herein, the term "PVRIG" or "PVRIG protein" or "PVRIG polypeptide" may optionally include any such protein, or variants, conjugates, or fragments thereof, including but not limited to known or wild type PVRIG, as described herein, as well as any naturally occurring splice variants, amino acid variants or isoforms, and in particular the ECD fragment of PVRIG.

As noted herein and more fully described below, anti-PVRIG antibodies (including antigen-binding fragments) that both bind to PVRIG and prevent activation by PVRL2 (e.g. most commonly by blocking the interaction of PVRIG and PVLR2), are used to enhance T cell and/or NK cell activation and be used in treating diseases such as cancer and pathogen infection.

E. TIGIT Proteins

The present invention provides antibodies that specifically bind to TIGIT proteins and prevent activation by its ligand protein, PVR, poliovirus receptor (a.k.a. CD155) a human plasma membrane glycoprotein. TIGIT, or T cell immunoreceptor with Ig and ITIM domains, is a co-inhibitory receptor protein also known as WUCAM, Vstm3 or Vsig9. TIGIT has an immunoglobulin variable domain, a transmembrane domain, and an immunoreceptor tyrosine-based inhibitory motif (ITIM) and contains signature sequence elements of the PVR protein family. The extracellular domain (ECD) sequences of TIGIT and of PVR are shown in FIG. 51. The antibodies of the invention are specific for the TIGIT ECD such that the binding of TIGIT and PVR is blocked Accordingly, as used herein, the term "TIGIT" or "TIGIT protein" or "TIGIT polypeptide" may optionally include any such protein, or variants, conjugates, or fragments thereof, including but not limited to known or wild type TIGIT, as described herein, as well as any naturally occurring splice variants, amino acid variants or isoforms, and in particular the ECD fragment of TIGIT.

As noted herein and more fully described below, anti-TIGIT antibodies (including antigen-binding fragments) that both bind to TIGIT and prevent activation by PVR (e.g. most commonly by blocking the interaction of TIGIT and PVR), are used to enhance T cell and/or NK cell activation and be used in treating diseases such as cancer and pathogen infection.

VI. ANTIBODIES

As is discussed below, the term "antibody" is used generally. Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to monoclonal antibodies that generally are based on the IgG class, which has several subclasses, including, but not limited to IgG1, IgG2, IgG3, and IgG4. In general, IgG1, IgG2 and IgG4 are used more frequently than IgG3. It should be noted that IgG1 has different allotypes with polymorphisms at 356 (D or E) and 358 (L or M). The sequences depicted herein use the 356D/358M allotype, however the other allotype is included herein. That is, any sequence inclusive of an IgG1 Fc domain included herein can have 356E/358L replacing the 356D/358M allotype.

The amino-terminal portion of each chain includes a variable region of about 100 to 110 or more amino acids primarily responsible for antigen recognition, generally referred to in the art and herein as the "Fv domain" or "Fv region". In the variable region, three loops are gathered for each of the V domains of the heavy chain and light chain to form an antigen-binding site. Each of the loops is referred to as a complementarity-determining region (hereinafter referred to as a "CDR"), in which the variation in the amino acid sequence is most significant. "Variable" refers to the fact that certain segments of the variable region differ extensively in sequence among antibodies. Variability within the variable region is not evenly distributed. Instead, the V regions consist of relatively invariant stretches called framework regions (FRs) of 15-30 amino acids separated by shorter regions of extreme variability called "hypervariable regions" that are each 9-15 amino acids long or longer.

Each VH and VL is composed of three hypervariable regions ("complementary determining regions," "CDRs") and four FRs, arranged from amino-terminus to carboxy-terminus in the following order: FR1-CDR1-FR2-CDR2-FR3-CDR3-FR4.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g. vhCDR1, vhCDR2 and vhCDR3) and the disclosure of each variable light region is a disclosure of the vlCDRs (e.g. vlCDR1, vlCDR2 and vlCDR3). A useful comparison of CDR numbering is as below, see Lafranc et al., Dev. Comp. Immunol. 27(1):55-77 (2003):

|  | Kabat + Clothia | IMGT | Kabat | AbM | Chothia | Contact |
| --- | --- | --- | --- | --- | --- | --- |
| vhCDR1 | 26-35 | 27-38 | 31-35 | 26-35 | 26-32 | 30-35 |
| vhCDR2 | 50-65 | 56-65 | 50-65 | 50-58 | 53-55 | 47-58 |
| vhCDR3 | 95-102 | 105-117 | 95-102 | 95-102 | 96-101 | 93-101 |
| vlCDR1 | 24-34 | 27-38 | 24-34 | 24-34 | 26-32 | 30-36 |
| vlCDR2 | 50-56 | 56-65 | 50-56 | 50-56 | 50-52 | 46-55 |
| vlCDR3 | 89-97 | 105-117 | 89-97 | 89-97 | 91-96 | 89-96 |

Throughout the present specification, the Kabat numbering system is generally used when referring to a residue in the variable domain (approximately, residues 1-107 of the light chain variable region and residues 1-113 of the heavy chain variable region) and the hinge and the EU numbering system for Fc regions (e.g., Kabat et al., supra (1991)).

The present invention provides a large number of different CDR sets. In this case, a "full CDR set" comprises the three variable light and three variable heavy CDRs, e.g. a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used, or on a single polypeptide chain in the case of scFv sequences.

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and non-conformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains.

The carboxy-terminal portion of each chain defines a constant region primarily responsible for effector function. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat.

"CH2" refers to positions 237-340 according to the EU index as in Kabat, and "CH3" refers to positions 341-447 according to the EU index as in Kabat.

Another type of Ig domain of the heavy chain is the hinge region. By "hinge" or "hinge region" or "antibody hinge region" or "immunoglobulin hinge region" herein is meant the flexible polypeptide comprising the amino acids between the first and second constant domains of an antibody. Structurally, the IgG CH1 domain ends at EU position 220, and the IgG CH2 domain begins at residue EU position 237. Thus for IgG the antibody hinge is herein defined to include positions 221 (D221 in IgG1) to 236 (G236 in IgG1), wherein the numbering is according to the EU index as in Kabat.

The light chain generally comprises two domains, the variable light domain (containing the light chain CDRs and together with the variable heavy domains forming the Fv region), and a constant light chain region (often referred to as CL or Cκ). In general, either the constant lambda or constant kappa domain can be used, with lambda generally finding use in the invention.

Another region of interest for additional substitutions, outlined below, is the Fc region.

A. Chimeric and Humanized Antibodies

In some embodiments, the antibodies herein can be derived from a mixture from different species, e.g. a chimeric antibody and/or a humanized antibody. In general, both "chimeric antibodies" and "humanized antibodies" refer to antibodies that combine regions from more than one species. For example, "chimeric antibodies" traditionally comprise variable region(s) from a mouse (or rat, in some cases) and the constant region(s) from a human. "Humanized antibodies" generally refer to non-human antibodies that have had the variable-domain framework regions swapped for sequences found in human antibodies. Generally, in a humanized antibody, the entire antibody, except the CDRs, is encoded by a polynucleotide of human origin or is identical to such an antibody except within its CDRs. The CDRs, some or all of which are encoded by nucleic acids originating in a non-human organism, are grafted into the beta-sheet framework of a human antibody variable region to create an antibody, the specificity of which is determined by the engrafted CDRs. The creation of such antibodies is described in, e.g., WO 92/11018, Jones, 1986, Nature 321: 522-525, Verhoeyen et al., 1988, Science 239:1534-1536, all entirely incorporated by reference. "Backmutation" of selected acceptor framework residues to the corresponding donor residues is often required to regain affinity that is lost in the initial grafted construct (U.S. Pat. No. 5,530,101; U.S. Pat. No. 5,585,089; U.S. Pat. No. 5,693,761; U.S. Pat. No. 5,693,762; U.S. Pat. No. 6,180,370; U.S. Pat. No. 5,859,205; U.S. Pat. No. 5,821,337; U.S. Pat. No. 6,054,297; U.S. Pat. No. 6,407,213, all entirely incorporated by reference). The humanized antibody optimally also will comprise at least a portion, and usually all, of an immunoglobulin constant region, typically that of a human immunoglobulin, and thus will typically comprise a human Fc region. Humanized antibodies can also be generated using mice with a genetically engineered immune system. Roque et al., 2004, Biotechnol. Prog. 20:639-654, entirely incorporated by reference. A variety of techniques and methods for humanizing and reshaping non-human antibodies are well known in the art (See Tsurushita & Vasquez, 2004, Humanization of Monoclonal Antibodies, Molecular Biology of B Cells, 533-545, Elsevier Science (USA), and references cited therein, all entirely incorporated by reference). Humanization methods include but are not limited to methods described in Jones et al., 1986, Nature 321:522-525; Riechmann et al., 1988; Nature 332:323-329; Verhoeyen et al., 1988, Science, 239:1534-1536; Queen et al., 1989, Proc Natl Acad Sci, USA 86:10029-33; He et al., 1998, J. Immunol. 160: 1029-1035; Carter et al., 1992, Proc Natl Acad Sci USA 89:4285-9, Presta et al., 1997, Cancer Res. 57(20):4593-9; Gorman et al., 1991, Proc. Natl. Acad. Sci. USA 88:4181-4185; O'Connor et al., 1998, Protein Eng 11:321-8, all entirely incorporated by reference. Humanization or other methods of reducing the immunogenicity of nonhuman antibody variable regions may include resurfacing methods, as described for example in Roguska et al., 1994, Proc. Natl. Acad. Sci. USA 91:969-973, entirely incorporated by reference.

Thus, the vhCDRs and vlCDRs from any of the enumerated antibodies herein may be humanized (or "rehumanized", for those that were already humanized).

In certain embodiments, the antibodies of the invention comprise a heavy chain variable region from a particular germline heavy chain immunoglobulin gene and/or a light chain variable region from a particular germline light chain immunoglobulin gene. For example, such antibodies may comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody. A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody may be at least 95, 96, 97, 98 or 99%, or even at least 96%, 97%, 98%, or 99% identical in amino acid sequence to the amino acid sequence encoded by the germline immunoglobulin gene excluding the CDRs. That is, the CDRs may be murine, but the framework regions of the variable region (either heavy or light) can be at least 96%, 97%, 98%, or 99% identical in amino acid sequence to the framework amino acids encoded by one human germline immunoglobulin gene.

Typically, a humanized antibody derived from a particular human germline sequence will display no more than 10-20 amino acid differences from the amino acid sequence encoded by the human germline immunoglobulin gene. In certain cases, the humanized antibody may display no more than 5, or even no more than 4, 3, 2, or 1 amino acid difference from the amino acid sequence encoded by the germline immunoglobulin gene (again, prior to the introduction of any variants herein; that is, the number of variants is generally low).

In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

B. Optional Antibody Engineering

The antibodies of the invention can be modified, or engineered, to alter the amino acid sequences by amino acid substitutions. As discussed herein, amino acid substitutions can be made to alter the affinity of the CDRs for the protein (e.g. TIGIT or PVRIG, including both increasing and decreasing binding), as well as to alter additional functional properties of the antibodies. For example, the antibodies may be engineered to include modifications within the Fc region, typically to alter one or more functional properties of the antibody, such as serum half-life, complement fixation, Fc receptor binding, and/or antigen-dependent cellular cytotoxicity. Furthermore, an antibody according to at least some embodiments of the invention may be chemically modified (e.g., one or more chemical moieties can be attached to the antibody) or be modified to alter its glycosylation, again to alter one or more functional properties of the antibody. Such embodiments are described further below. The numbering of residues in the Fc region is that of the EU index of Kabat.

In one embodiment, the hinge region of CH1 is modified such that the number of cysteine residues in the hinge region is altered, e.g., increased or decreased. This approach is described further in U.S. Pat. No. 5,677,425 by Bodmer et al. The number of cysteine residues in the hinge region of CH1 is altered to, for example, facilitate assembly of the light and heavy chains or to increase or decrease the stability of the antibody.

In still another embodiment, the antibody can be modified to abrogate in vivo Fab arm exchange, in particular when IgG4 constant domains are used. Specifically, this process involves the exchange of IgG4 half-molecules (one heavy chain plus one light chain) between other IgG4 antibodies that effectively results in bispecific antibodies which are functionally monovalent. Mutations to the hinge region and constant domains of the heavy chain can abrogate this exchange (see Aalberse, R C, Schuurman J., 2002, *Immunology* 105:9-19). As outlined herein, a mutation that finds particular use in the present invention is the S241P in the context of an IgG4 constant domain. IgG4 finds use in the present invention as it has no significant effector function, and is thus used to block the receptor binding to its ligand without cell depletion (e.g. PVRIG to PVRL2 or TIGIT to PVR).

In some embodiments, amino acid substitutions can be made in the Fc region, in general for altering binding to FcγR receptors. By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIIb-NA1 and FcγRIIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII-1 (CD16), and FcγRIII-2 (CD16-2), as well as any undiscovered mouse FcγRs or FcγR isoforms or allotypes.

There are a number of useful Fc substitutions that can be made to alter binding to one or more of the FcγR receptors. Substitutions that result in increased binding as well as decreased binding can be useful. For example, it is known that increased binding to FcγRIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell. Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41) and U.S. Pat. No. 6,737,056, both of which are expressly incorporated herein by reference in their entirety and specifically for the variants disclosed therein.

In yet another example, the Fc region is modified to increase the ability of the antibody to mediate antibody dependent cellular cytotoxicity (ADCC) and/or to increase the affinity of the antibody for an Fcγ receptor, and/or increase FcRn binding, by modifying one or more amino acids at the following positions: 238, 239, 248, 249, 252, 254, 255, 256, 258, 265, 267, 268, 269, 270, 272, 276, 278, 280, 283, 285, 286, 289, 290, 292, 293, 294, 295, 296, 298, 301, 303, 305, 307, 309, 312, 315, 320, 322, 324, 326, 327, 329, 330, 331, 333, 334, 335, 337, 338, 340, 360, 373, 376, 378, 382, 388, 389, 398, 414, 416, 419, 430, 434, 435, 437, 438 or 439. This approach is described further in PCT Publication WO 00/42072 by Presta. Moreover, the binding sites on human IgG1 for FcγRI, FcγRII, FcγRIII and FcRn have been mapped and variants with improved binding have been described (see Shields, R. L. et al. (2001) *J. Biol. Chem.* 276:6591-6604). Specific mutations at positions 256, 290, 298, 333, 334 and 339 are shown to improve binding to FcγRIII. Additionally, the following combination mutants are shown to improve FcγRIII binding: T256A/S298A, S298A/E333A, S298A/K224A and S298A/E333A/K334A. Furthermore, mutations such as M252Y/S254T/T256E or M428L/N434S improve binding to FcRn and increase antibody circulation half-life (see Chan C A and Carter P J (2010) *Nature Rev Immunol* 10:301-316).

In addition, the antibodies of the invention are modified to increase its biological half-life. Various approaches are possible. For example, one or more of the following mutations can be introduced: T252L, T254S, T256F, as described in U.S. Pat. No. 6,277,375 to Ward. Alternatively, to increase the biological half-life, the antibody can be altered within the $C_{H1}$ or $C_L$ region to contain a salvage receptor binding epitope taken from two loops of a CH2 domain of an Fc region of an IgG, as described in U.S. Pat. Nos. 5,869,046 and 6,121,022 by Presta et al. Additional mutations to increase serum half-life are disclosed in U.S. Pat. Nos. 8,883,973, 6,737,056 and 7,371,826 and include 428L, 434A, 434S, and 428L/434S.

In still another embodiment, the glycosylation of an antibody is modified. For example, an aglycosylated antibody can be made (i.e., the antibody lacks glycosylation). Glycosylation can be altered to, for example, increase the affinity of the antibody for antigen or reduce effector function such as ADCC. Such carbohydrate modifications can be accomplished by, for example, altering one or more sites of glycosylation within the antibody sequence, for example N297. For example, one or more amino acid substitutions can be made that result in elimination of one or more variable region framework glycosylation sites to thereby eliminate glycosylation at that site, with an alanine replacement finding use in some embodiments.

Additionally or alternatively, an antibody can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant antibodies according to at least some embodiments of the invention to thereby produce an antibody with altered glycosylation. See for example, U.S. Patent Publication No. 20040110704 and WO 2003/035835.

Another modification of the antibodies herein that is contemplated by the invention is PEGylation or the addition of other water soluble moieties, typically polymers, e.g., in order to enhance half-life. An antibody can be PEGylated to, for example, increase the biological (e.g., serum) half-life of the antibody as is known in the art.

In addition to substitutions made to alter binding affinity to FcγRs and/or FcRn and/or increase in vivo serum half-life, additional antibody modifications can be made, as described in further detail below.

In some cases, affinity maturation is done. Amino acid modifications in the CDRs are sometimes referred to as "affinity maturation". An "affinity matured" antibody is one having one or more alteration(s) in one or more CDRs which results in an improvement in the affinity of the antibody for antigen, compared to a parent antibody which does not possess those alteration(s). In some cases, it may be desirable to decrease the affinity of an antibody to its antigen.

In some embodiments, one or more amino acid modifications are made in one or more of the CDRs of the antibodies of the invention (PVRIG or TIGIT antibodies). In general, only 1 or 2 or 3-amino acids are substituted in any single CDR, and generally no more than from 1, 2, 3. 4, 5, 6, 7, 8 9 or 10 changes are made within a set of 6 CDRs (e.g. vhCDR1-3 and vlCDR1-3). However, it should be appreciated that any combination of no substitutions, 1, 2 or 3 substitutions in any CDR can be independently and optionally combined with any other substitution.

Affinity maturation can be done to increase the binding affinity of the antibody for the antigen by at least about 10% to 50-100-150% or more, or from 1 to 5 fold as compared to the "parent" antibody. Preferred affinity matured antibodies will have nanomolar or even picomolar affinities for the antigen. Affinity matured antibodies are produced by known procedures. The correlation of affinity and efficacy is discussed below.

Alternatively, amino acid modifications can be made in one or more of the CDRs of the antibodies of the invention that are "silent", e.g. that do not significantly alter the affinity of the antibody for the antigen. These can be made for a number of reasons, including optimizing expression (as can be done for the nucleic acids encoding the antibodies of the invention).

Thus, included within the definition of the CDRs and antibodies of the invention are variant CDRs and antibodies; that is, the antibodies of the invention can include amino acid modifications in one or more of the CDRs of the enumerated antibodies of the invention. In addition, as outlined below, amino acid modifications can also independently and optionally be made in any region outside the CDRs, including framework and constant regions.

a. Generation of Additional Antibodies

Additional antibodies to human PVRIG can be done as is well known in the art, using well known methods such as those outlined in the examples. Thus, additional anti-PVRIG antibodies can be generated by traditional methods such as immunizing mice (sometimes using DNA immunization, for example, such as is used by Aldevron), followed by screening against human PVRIG protein and hybridoma generation, with antibody purification and recovery.

VII. TIGIT ANTIBODIES OF THE INVENTION

The present invention provides anti-TIGIT antibodies. (For convenience, "anti-TIGIT antibodies" and "TIGIT antibodies" are used interchangeably). The anti-TIGIT antibodies of the invention specifically bind to human TIGIT, and preferably the ECD of human TIGIT. The invention further provides antigen binding domains, including full length antibodies, which contain a number of specific, enumerated sets of 6 CDRs, that bind to TIGIT.

Specific binding for TIGIT or a TIGIT epitope can be exhibited, for example, by an antibody having a $K_D$ of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, at least about $10^{-13}$ M, at least about $10^{-14}$ M, at least about $10^{-15}$ M, or greater, where $K_D$ refers to the equilibrium dissociation constant of a particular antibody-antigen interaction. Typically, an antibody that specifically binds an antigen will have a $K_D$ that is 20-, 50-, 100-, 500-, 1000-, 5,000-, 10,000- or more times greater for a control molecule relative to the TIGIT antigen or epitope.

However, for optimal binding to TIGIT expressed on the surface of NK and T-cells, the antibodies preferably have a KD less 50 nM and most preferably less than 1 nM, with less than 0.1 nM and less than 1 pM finding use in the methods of the invention Also, specific binding for a particular antigen or an epitope can be exhibited, for example, by an antibody having a ka (referring to the association rate constant) for a TIGIT antigen or epitope of at least 20-, 50-, 100-, 500-, 1000-, 5,000-, 10,000- or more times greater for the epitope relative to a control, where ka refers to the association rate constant of a particular antibody-antigen interaction.

In some embodiments, the anti-TIGIT antibodies of the invention bind to human TIGIT with a $K_D$ of 100 nM or less, 50 nM or less, 10 nM or less, or 1 nM or less (that is, higher binding affinity), or 1 pM or less, wherein $K_D$ is determined by known methods, e.g. surface plasmon resonance (SPR, e.g. Biacore assays), ELISA, KINEXA, and most typically SPR at 25° or 37° C.

The TIGIT antibodies described herein are labeled as follows. The antibodies have reference numbers, for example "CPA.9.086". This represents the combination of the variable heavy and variable light chains, as depicted in FIG. 53, for example, with the understanding that these antibodies include two heavy chains and two light chains. "CPA.9.086.VH" refers to the variable heavy portion of CPA. 9. 086, while "CPA. 9. 086.VL" is the variable light chain. "CPA. 9. 086.vhCDR1", "CPA. 9. 086.vhCDR2", "CPA. 9. 086.vhCDR3", "CPA. 9. 086.vlCDR1", "CPA. 9. 086.vlCDR2", and "CPA. 9. 086.vlCDR3", refers to the CDRs are indicated. "CPA. 9. 086.HC" refers to the entire heavy chain (e.g. variable and constant domain) of this molecule, and "CPA. 9. 086.LC" refers to the entire light chain (e.g. variable and constant domain) of the same molecule. In general, the human kappa light chain is used for the constant domain of each phage (or humanized hybridoma) antibody herein, although in some embodiments the lambda light constant domain is used. "CPA. 9. 086.H1" refers to a full length antibody comprising the variable heavy and light domains, including the constant domain of Human IgG1 (hence, the H1; IgG1, IgG2, IgG3 and IgG4 sequences are shown in FIG. 50). Accordingly, "CPA. 9. 086.H2" would be the CPA. 9. 086 variable domains linked to a Human IgG2. "CPA. 9. 086.H3" would be the CPA. 9. 086 variable domains linked to a Human IgG3, and "CPA. 9. 086.H4" would be the CPA. 9. 086 variable domains linked to a Human IgG4. Note that in some cases, the human IgGs may have additional mutations, such are described below, and this can be annotated. For example, in many embodiments, there may be a S241P mutation in the human IgG4, and this can be annotated as "CPA.9.086.H4(S241P)" for example. The human IgG4 sequence with this S241P hinge variant is shown in FIG. 50. Other potential variants are IgG1(N297A), (or other variants that ablate glycosylation at this site and thus many of the effector functions associated with FcγRIIIa binding), and IgG1(D265A), which reduces binding to FcγR receptors.

The invention further provides variable heavy and light domains as well as full length heavy and light chains.

In some embodiments, the invention provides scFvs that bind to TIGIT comprising a variable heavy domain and a variable light domain linked by an scFv linker as outlined above. The VL and VH domains can be in either orientation, e.g. from N- to C-terminus "VH-linker-VL" or "VL-linker" VH". These are named by their component parts; for example, "scFv-CPA. 9.086.VH-linker-VL" or "scFv-CPA.9.086.VL-linker-VH." Thus, "scFv-CPA.9.086" can be in either orientation.

In many embodiments, the antibodies of the invention are human (derived from phage) and block binding of TIGIT and PVR. As shown in FIGS. 58 and 75, the CPA antibodies that both bind and block the receptor-ligand interaction are as below, with their components outlined as well (as discussed in the "Sequence" section, the sequences of all but the scFv constructs are in the sequence listing):

CPA.9.018, CPA.9.018.VH, CPA.9.018.VL, CPA.9.018.HC, CPA.9.018.LC, CPA.9.018.H1, CPA.9.018.H2, CPA.9.018.H3, CPA.9.018.H4; CPA.9.018.H4(S241P); CPA.9.018.vhCDR1, CPA.9.018.vhCDR2, CPA.9.018.vhCDR3, CPA.9.018.vlCDR1, CPA.9.018.vlCDR2, CPA.9.018.vlCDR3 and scFv-CPA.9.018;
CPA.9.027, CPA.9.027.VH, CPA.9.027.VL, CPA.9.027.HC, CPA.9.027.LC, CPA.9.027.H1, CPA.9.027.H2, CPA.9.027.H3, CPA.9.027.H4; CPA.9.018.H4(S241P); CPA.9.027.vhCDR1, CPA.9.027.vhCDR2, CPA.9.027.vhCDR3, CPA.9.027.vlCDR1, CPA.9.027.vlCDR2, CPA.9.027.vlCDR3 and scFv-CPA.9.027;
CPA.9.049, CPA.9.049.VH, CPA.9.049.VL, CPA.9.049.HC, CPA.9.049.LC, CPA.9.049.H1, CPA.9.049.H2, CPA.9.049.H3; CPA.9.049.H4; CPA.9.049.H4(S241P); CPA.9.049.vhCDR1, CPA.9.049.vhCDR2, CPA.9.049.vhCDR3, CPA.9.049.vlCDR1, CPA.9.049.vlCDR2, CPA.9.049.vlCDR3 and scFv-CPA.9.049;
CPA.9.057, CPA.9.057.VH, CPA.9.057.VL, CPA.9.057.HC, CPA.9.057.LC, CPA.9.057.H1, CPA.9.057.H2, CPA.9.057.H3; CPA.9.057.H4; CPA.9.057.H4(S241P); CPA.9.057.vhCDR1, CPA.9.057.vhCDR2, CPA.9.057.vhCDR3, CPA.9.057.vlCDR1, CPA.9.057.vlCDR2, CPA.9.057.vlCDR3 and scFv-CPA.9.057;
CPA.9.059, CPA.9.059.VH, CPA.9.059.VL, CPA.9.059.HC, CPA.9.059.LC, CPA.9.059.H1, CPA.9.059.H2, CPA.9.059.H3; CPA.9.059.H4; CPA.9.059.H4(S241P); CPA.9.059.vhCDR1, CPA.9.059.vhCDR2, CPA.9.059.vhCDR3, CPA.9.059.vlCDR1, CPA.9.059.vlCDR2, CPA.9.059.vlCDR3 and scFv-CPA.9.059;
CPA.9.083, CPA.9.083.VH, CPA.9.083.VL, CPA.9.083.HC, CPA.9.083.LC, CPA.9.083.H1, CPA.9.083.H2, CPA.9.083.H3; CPA.9.083.H4; CPA.9.083.H4(S241P); CPA.9.083.vhCDR1, CPA.9.083.vhCDR2, CPA.9.083.vhCDR3, CPA.9.083.vlCDR1, CPA.9.083.vlCDR2, CPA.9.083.vlCDR3 and scFv-CPA.9.083;
CPA.9.086, CPA.9.086.VH, CPA.9.086.VL, CPA.9.086.HC, CPA.9.086.LC, CPA.9.086.H1, CPA.9.086.H2, CPA.9.086.H3; CPA.9.086.H4; CPA.9.086.H4(S241P); CPA.9.086.vhCDR1, CPA.9.086.vhCDR2, CPA.9.086.vhCDR3, CPA.9.086.vlCDR1, CPA.9.086.vlCDR2, CPA.9.086.vlCDR3 and scFv-CPA.9.086;
CPA.9.089, CPA.9.089.VH, CPA.9.089.VL, CPA.9.089.HC, CPA.9.089.LC, CPA.9.089.H1, CPA.9.089.H2, CPA.9.089.H3; CPA.9.089.H4; CPA.9.089.H4(S241P); CPA.9.089.vhCDR1, CPA.9.089.vhCDR2, CPA.9.089.vhCDR3, CPA.9.089.vlCDR1, CPA.9.089.vlCDR2, CPA.9.089.vlCDR3 and scFv-CPA.9.089;
CPA.9.093, CPA.9.093.VH, CPA.9.093.VL, CPA.9.093.HC, CPA.9.093.LC, CPA.9.093.H1, CPA.9.093.H2, CPA.9.093.H3; CPA.9.093.H4; CPA.9.093.H4(S241P); CPA.9.093.vhCDR1, CPA.9.093.vhCDR2, CPA.9.093.vhCDR3, CPA.9.093.vlCDR1, CPA.9.093.vlCDR2, CPA.9.093.vlCDR3 and scFv-CPA.9.093;
CPA.9.101, CPA.9.101.VH, CPA.9.101.VL, CPA.9.101.HC, CPA.9.101.LC, CPA.9.101.H1, CPA.9.101.H2, CPA.9.101.H3; CPA.9.101.H4; CPA.9.101.H4(S241P); CPA.9.101.vhCDR1, CPA.9.101.vhCDR2, CPA.9.101.vhCDR3, CPA.9.101.vlCDR1, CPA.9.101.vlCDR2, CPA.9.101.vlCDR3 and scFv-CPA.9.101; and
CPA.9.103, CPA.9.103.VH, CPA.9.103.VL, CPA.9.103.HC, CPA.9.103.LC, CPA.9.103.H1, CPA.9.103.H2, CPA.9.103.H3; CPA.9.103.H4; CPA.9.103.H4(S241P); CPA.9.103.vhCDR1, CPA.9.103.vhCDR2, CPA.9.103.vhCDR3, CPA.9.103.vlCDR1, CPA.9.103.vlCDR2, CPA.9.103.vlCDR3 and scFv-CPA.9.103.

Furthermore, the present invention provides a number of CHA antibodies, which are murine antibodies generated from hybridomas. As is well known the art, the six CDRs are useful when put into either human framework variable heavy and variable light regions or when the variable heavy and light domains are humanized.

Accordingly, the present invention provides antibodies, usually full length or scFv domains, that comprise the following sets of CDRs, the sequences of which are shown in FIG. 53 and/or the sequence listing:

CHA.9.536.1, CHA.9.536.1.VH, CHA.9.536.1.VL, CHA.9.536.1.HC, CHA.9.536.1.LC, CHA.9.536.1.H1, CHA.9.536.1.H2, CHA.9.536.1.H3; CHA.9.536.1.H4, CHA.9.536.1.H4(S241P), CHA.9.536.1.vhCDR1, CHA.9.536.1.vhCDR2, CHA.9.536.1.vhCDR3, CHA.9.536.1.vlCDR1, CHA.9.536.1.vlCDR2 and CHA.9.536.1.vhCDR3;

CHA.9.536.3, CHA.9.536.3.VH, CHA.9.536.3.VL, CHA.9.536.3.HC, CHA.9.536.3.LC, CHA.9.536.3.H1, CHA.9.536.3.H2, CHA.9.536.3.H3; CHA.9.536.3.H4, CHA.9.536.3.H4(S241P); CHA.9.536.3.vhCDR1, CHA.9.536.3.vhCDR2, CHA.9.536.3.vhCDR3, CHA.9.536.3.vlCDR1, CHA.9.536.3.vlCDR2 and CHA.9.536.3.vhCDR3;

CHA.9.536.4, CHA.9.536.4.VH, CHA.9.536.4.VL, CHA.9.536.4.HC, CHA.9.536.4.LC, CHA.9.536.4.H1, CHA.9.536.4.H2, CHA.9.536.4.H3; CHA.9.536.4.H4, CHA.9.536.4.H4(S241P), CHA.9.536.4.vhCDR1, CHA.9.536.4.vhCDR2, CHA.9.536.4.vhCDR3, CHA.9.536.4.vlCDR1, CHA.9.536.4.vlCDR2 and CHA.9.536.4.vhCDR3;

CHA.9.536.5, CHA.9.536.5.VH, CHA.9.536.5.VL, CHA.9.536.5.HC, CHA.9.536.5.LC, CHA.9.536.5.H1, CHA.9.536.5.H2, CHA.9.536.5.H3; CHA.9.536.5.H4, CHA.9.536.5.H4(S241P), CHA.9.536.5.vhCDR1, CHA.9.536.5.vhCDR2, CHA.9.536.5.vhCDR3, CHA.9.536.5.vlCDR1, CHA.9.536.5.vlCDR2 and CHA.9.536.5.vhCDR3;

CHA.9.536.6, CHA.9.536.6.VH, CHA.9.536.6.VL, CHA.9.536.6.HC, CHA.9.536.6.LC, CHA.9.536.6.H1, CHA.9.536.6.H2, CHA.9.536.6.H3; CHA.9.536.6.H4, CHA.9.536.6.vhCDR1, CHA.9.536.6.vhCDR2, CHA.9.536.6.vhCDR3, CHA.9.536.6.vlCDR1, CHA.9.536.6.vlCDR2 and CHA.9.536.6.vhCDR3;

CHA.9.536.7, CHA.9.536.7.VH, CHA.9.536.7.VL, CHA.9.536.7.HC, CHA.9.536.7.LC, CHA.9.536.7.H1, CHA.9.536.7.H2, CHA.9.536.7.H3; CHA.9.536.7.H4, CHA.9.536.5.H4(S241P); CHA.9.536.7.vhCDR1, CHA.9.536.7.vhCDR2, CHA.9.536.7.vhCDR3, CHA.9.536.7.vlCDR1, CHA.9.536.7.vlCDR2 and CHA.9.536.7.vhCDR3;

CHA.9.536.8, CHA.9.536.8.VH, CHA.9.536.8.VL, CHA.9.536.8.HC, CHA.9.536.8.LC, CHA.9.536.8.H1, CHA.9.536.8.H2, CHA.9.536.8.H3; CHA.9.536.8.H4, CHA.9.536.8.H4(S241P), CHA.9.536.8.vhCDR1, CHA.9.536.8.vhCDR2, CHA.9.536.8.vhCDR3, CHA.9.536.8.vlCDR1, CHA.9.536.8.vlCDR2 and CHA.9.536.8.vhCDR3;

CHA.9.560.1, CHA. 9.560.1VH, CHA. 9.560.1.VL, CHA. 9.560.1.HC, CHA. 9.560.1.LC, CHA. 9.560.1.H1, CHA. 9.560.1.H2, CHA. 9.560.1.H3; CHA. 9.560.1.H4, CHA. 9.560.1.H4(S241P), CHA. 9.560.1.vhCDR1, CHA. 9.560.1.vhCDR2, CHA. 9.560.1.vhCDR3, CHA. 9.560.1.vlCDR1, CHA. 9.560.1.vlCDR2 and CHA. 9.560.1.vhCDR3;

CHA.9.560.3, CHA. 9.560. 3VH, CHA. 9.560. 3.VL, CHA. 9.560. 3.HC, CHA. 9.560. 3.LC, CHA. 9.560. 3.H1, CHA. 9.560. 3.H2, CHA. 9.560. 3.H3; CHA.9.560.3.H4, CHA.9.560.3.H4(S241P); CHA. 9.560. 3.vhCDR1, CHA. 9.560. 3.vhCDR2, CHA. 9.560. 3.vhCDR3, CHA. 9.560. 3.vlCDR1, CHA. 9.560. 3.vlCDR2 and CHA. 9.560. 3.vhCDR3;

CHA.9.560.4, CHA. 9.560. 4VH, CHA. 9.560. 4.VL, CHA. 9.560. 4.HC, CHA. 9.560. 4.LC, CHA. 9.560. 4.H1, CHA. 9.560. 4.H2, CHA. 9.560. 4.H3; CHA.9.560.4.H4, CHA.9.560.4.H4(S241P), CHA. 9.560. 4.vhCDR1, CHA. 9.560. 4.vhCDR2, CHA. 9.560. 4.vhCDR3, CHA. 9.560. 4.vlCDR1, CHA. 9.560. 4.vlCDR2 and CHA. 9.560. 4.vhCDR3;

CHA.9.560.5, CHA. 9.560. 5VH, CHA. 9.560. 5.VL, CHA. 9.560. 5.HC, CHA. 9.560. 5.LC, CHA. 9.560. 5.H1, CHA. 9.560. 5.H2, CHA. 9.560. 5.H3; CHA. 9.560. 5.H4, CHA. 9.560. 5.vhCDR1, CHA. 9.560. 5.vhCDR2, CHA. 9.560. 5.vhCDR3, CHA. 9.560. 5.vlCDR1, CHA. 9.560. 5.vlCDR2 and CHA. 9.560. 5.vhCDR3;

CHA.9.560.6, CHA. 9.560. 6VH, CHA. 9.560. 6.VL, CHA. 9.560. 6.HC, CHA. 9.560. 6.LC, CHA. 9.560. 6.H1, CHA. 9.560. 6.H2, CHA. 9.560. 6.H3; CHA.9.560.6.H4, CHA.9.560.6.H4(S241P), CHA. 9.560. 6.vhCDR1, CHA. 9.560. 6.vhCDR2, CHA. 9.560. 6.vhCDR3, CHA. 9.560. 6.vlCDR1, CHA. 9.560. 6.vlCDR2 and CHA. 9.560. 6.vhCDR3;

CHA.9.560.7, CHA. 9.560. 7VH, CHA. 9.560. 7.VL, CHA. 9.560. 7.HC, CHA. 9.560. 7.LC, CHA. 9.560. 7.H1, CHA. 9.560. 7.H2, CHA. 9.560. 7.H3; CHA.9.560.7.H4; CHA.9.560.7.H4(S241P); CHA. 9.560. 7.vhCDR1, CHA. 9.560. 7.vhCDR2, CHA. 9.560. 7.vhCDR3, CHA. 9.560. 7.vlCDR1, CHA. 9.560. 7.vlCDR2 and CHA. 9.560. 7.vhCDR3;

CHA.9.560.8, CHA. 9.560. 8VH, CHA. 9.560. 8.VL, CHA. 9.560. 8.HC, CHA. 9.560. 8.LC, CHA. 9.560. 8.H1, CHA. 9.560. 8.H2, CHA. 9.560. 8.H3; CHA.9.560.8.H4, CHA.9.560.8.H4(S241P); CHA. 9.560. 8.vhCDR1, CHA. 9.560. 8.vhCDR2, CHA. 9.560. 8.vhCDR3, CHA. 9.560. 8.vlCDR1, CHA. 9.560. 8.vlCDR2 and CHA. 9.560. 8.vhCDR3;

CHA.9.546.1, CHA. 9. 546.1VH, CHA. 9. 546.1.VL, CHA. 9. 546.1.HC, CHA. 9. 546.1.LC, CHA. 9. 546.1.H1, CHA. 9. 546.1.H2, CHA. 9. 546.1.H3; CHA.9.546.1.H4, CHA.9.546.1.H4(S241P), CHA. 9. 546.1.vhCDR1, CHA. 9. 546.1.vhCDR2, CHA. 9. 546.1.vhCDR3, CHA. 9. 546.1.vlCDR1, CHA. 9. 546.1.vlCDR2 and CHA. 9. 546.1.vhCDR3;

CHA.9.547.1, CHA. 9. 547.1VH, CHA. 9. 547.1.VL, CHA. 9. 547.1.HC, CHA. 9. 547.1.LC, CHA. 9. 547.1.H1, CHA. 9. 547.1.H2, CHA. 9. 547.1.H3; CHA.9.547.1.H4, CHA.9.547.1.H4(S241P), CHA. 9. 547.1.vhCDR1, CHA. 9. 547.1.vhCDR2, CHA. 9. 547.1.vhCDR3, CHA. 9. 547.1.vlCDR1, CHA. 9. 547.1.vlCDR2 and CHA. 9. 547.1.vhCDR3;

CHA.9.547.2, CHA. 9. 547. 2VH, CHA. 9. 547. 2.VL, CHA. 9. 547. 2.HC, CHA. 9. 547. 2.LC, CHA. 9. 547. 2.H1, CHA. 9. 547. 2.H2, CHA. 9. 547. 2.H3; CHA.9.547.2.H4, CHA.9.547.2.H4(S241P), CHA. 9. 547. 2.vhCDR1, CHA. 9.547. 2.vhCDR2, CHA. 9. 547. 2.vhCDR3, CHA. 9. 547. 2.vlCDR1, CHA. 9.547. 2.vlCDR2 and CHA. 9. 547. 2.vhCDR3;

CHA.9.547.3, CHA. 9. 547. 3VH, CHA. 9. 547. 3.VL, CHA. 9. 547. 3.HC, CHA. 9. 547. 3.LC, CHA. 9. 547. 3.H1, CHA. 9. 547. 3.H2, CHA. 9. 547. 3.H3; CHA.9.547.3.H4, CHA.9.547.3.H4(S241P), CHA. 9. 547. 3.vhCDR1, CHA. 9.547. 3.vhCDR2, CHA. 9. 547. 3.vhCDR3, CHA. 9. 547. 3.vlCDR1, CHA. 9. 547. 3.vlCDR2 and CHA. 9. 547. 3.vhCDR3;

CHA.9.547.4, CHA. 9. 547. 4VH, CHA. 9. 547. 4.VL, CHA. 9. 547. 4.HC, CHA. 9.547. 4.LC, CHA. 9. 547. 4.H1,

CHA. 9. 547. 4.H2, CHA. 9. 547. 4.H3; CHA.9.547.4.H4, CHA.9.547.4.H4(S241P), CHA. 9. 547. 4.vhCDR1, CHA. 9. 547. 4.vhCDR2, CHA. 9. 547. 4.vhCDR3, CHA. 9. 547. 4.vlCDR1, CHA. 9. 547. 4.vlCDR2 and CHA. 9. 547. 4.vhCDR3;

CHA.9.547.6, CHA. 9. 547. 6 VH, CHA. 9. 547. 6.VL, CHA. 9. 547. 6.HC, CHA. 9. 547. 6.LC, CHA. 9. 547. 6.H1, CHA. 9. 547. 6.H2, CHA. 9. 547. 6.H3; CHA.9.547.6.H4, CHA.9.547.6.H4(S241P), CHA. 9. 547. 6.vhCDR1, CHA. 9.547. 6.vhCDR2, CHA. 9. 547. 6.vhCDR3, CHA. 9. 547. 6.vlCDR1, CHA. 9.547. 6.vlCDR2 and CHA. 9. 547. 6.vhCDR3;

CHA.9.547.7, CHA. 9. 547. 7VH, CHA. 9. 547. 7.VL, CHA. 9. 547. 7.HC, CHA. 9. 547. 7.LC, CHA. 9. 547. 7.H1, CHA. 9. 547. 7.H2, CHA. 9. 547. 7.H3; CHA.9.547.7.H4, CHA.9.547.7.H4(S241P), CHA. 9. 547. 7.vhCDR1, CHA. 9.547. 7.vhCDR2, CHA. 9. 547. 7.vhCDR3, CHA. 9. 547. 7.vlCDR1, CHA. 9.547. 7.vlCDR2 and CHA. 9. 547. 7.vhCDR3;

CHA.9.547.8, CHA. 9. 547. 8VH, CHA. 9. 547. 8.VL, CHA. 9. 547. 8.HC, CHA.9.547.8.LC, CHA. 9. 547. 8.H1, CHA. 9. 547. 8.H2, CHA. 9. 547. 8.H3; CHA.9.547.8.H4, CHA.9.547.8.H4(S241P), CHA. 9. 547. 8.vhCDR1, CHA. 9.547. 8.vhCDR2, CHA. 9. 547. 8.vhCDR3, CHA. 9. 547. 8.vlCDR1, CHA. 9.547. 8.vlCDR2 and CHA. 9. 547. 8.vhCDR3;

CHA.9.547.9, CHA.9.547.9, CHA.9.547.9VH, CHA.9.547.9.VL, CHA.9. 547.9.HC, CHA.9.547.9.LC, CHA.9.547.9.H1, CHA.9.547.9.H2, CHA.9.547.9.H3; CHA.9.547.9.H4, CHA.9.547.9.H4, CHA.9.547.9.H4 (S241P), CHA.9.547.9.H4(S241P), CHA.9.547.9.vhCDR1, CHA.9.547.9.vhCDR2, CHA.9.547.9.vhCDR3, CHA.9.547.9.vlCDR1, CHA.9.547.9.vlCDR2 and CHA.9.547.9.vhCDR3;

CHA.9.547.13, CHA.9.547.13, CHA.9.547. 13VH, CHA.9. 547.13.VL, CHA.9. 547.13.HC, CHA. 9.547.13.LC, CHA. 9.547.13.H1, CHA.9.547.13.H2, CHA.9. 547.13.H3; CHA.9.547.13.H4, CHA.9.547.13.H4, CHA.9.547.13.H4(S241P), CHA.9.547.13.H4(S241P), CHA. 9. 547.13.vhCDR1, CHA.9.547.13.vhCDR2, CHA.9.547. 13.vhCDR3, CHA. 9. 547.13.vlCDR1, CHA. 9. 547.13.vlCDR2 and CHA. 9. 547. 13.vhCDR3;

CHA.9.541.1, CHA. 9. 541.1.VH, CHA. 9. 541.1.VL, CHA. 9. 541.1.HC, CHA. 9. 541.1.LC, CHA. 9. 541.1.H1, CHA. 9. 541.1.H2, CHA. 9. 541.1.H3; CHA.9.541.1.H4, CHA.9.541.1.H4(S241P), CHA. 9. 541.1.vhCDR1, CHA. 9. 541.1.vhCDR2, CHA. 9. 541.1.vhCDR3, CHA. 9. 541.1.vlCDR1, CHA. 9. 541.1.vlCDR2 and CHA. 9.541.1.vhCDR3;

CHA.9.541.3, CHA. 9. 541. 3.VH, CHA. 9. 541. 3.VL, CHA. 9. 541. 3.HC, CHA. 9. 541. 3.LC, CHA. 9. 541. 3.H1, CHA. 9. 541. 3.H2, CHA. 9. 541. 3.H3; CHA.9.541.3.H4, CHA.9.541.3.H4(S241P), CHA. 9. 541. 3.vhCDR1, CHA. 9.541. 3.vhCDR2, CHA. 9. 541. 3.vhCDR3, CHA. 9. 541. 3.vlCDR1, CHA. 9.541. 3.vlCDR2 and CHA. 9.541. 3.vhCDR3;

CHA.9.541.4, CHA. 9. 541.4.VH, CHA. 9. 541. 4.VL, CHA. 9. 541. 4.HC, CHA. 9. 541. 4.LC, CHA. 9. 541. 4.H1, CHA. 9. 541. 4.H2, CHA. 9. 541. 4.H3; CHA.9.541.4.H4, CHA.9.541.4.H4(S241P), CHA. 9. 541. 4.vhCDR1, CHA. 9. 541. 4.vhCDR2, CHA. 9. 541. 4.vhCDR3, CHA. 9. 541. 4.vlCDR1, CHA. 9. 541. 4.vlCDR2 and CHA. 9.541. 4.vhCDR3;

CHA.9.541.5, CHA. 9. 541. 5.VH, CHA. 9. 541. 5.VL, CHA. 9. 541. 5.HC, CHA. 9. 541. 5.LC, CHA. 9. 541. 5.H1, CHA. 9. 541. 5.H2, CHA. 9. 541. 5.H3; CHA.9.541.5.H4, CHA.9.541.5.H4(S241P), CHA. 9. 541. 5.vhCDR1, CHA. 9.541. 5.vhCDR2, CHA. 9. 541. 5.vhCDR3, CHA. 9. 541. 5.vlCDR1, CHA. 9.541. 5.vlCDR2 and CHA. 9.541. 5.vhCDR3;

CHA.9.541.6, CHA. 9. 541. 6.VH, CHA. 9. 541. 6.VL, CHA. 9. 541. 6.HC, CHA. 9. 541. 6.LC, CHA. 9. 541. 6.H1, CHA. 9. 541. 6.H2, CHA. 9. 541.6.H3; CHA.9.541.6.H4, CHA.9.541.6.H4(S241P), CHA. 9. 541. 6.vhCDR1, CHA. 9.541. 6.vhCDR2, CHA. 9. 541. 6.vhCDR3, CHA. 9. 541. 6.vlCDR1, CHA. 9.541. 6.vlCDR2 and CHA. 9.541. 6.vhCDR3;

CHA.9.541.7, CHA. 9. 541. 7.VH, CHA. 9. 541. 7.VL, CHA. 9. 541. 7.HC, CHA. 9. 541. 7.LC, CHA. 9. 541. 7.H1, CHA. 9. 541. 7.H2, CHA. 9. 541. 7.H3; CHA.9.541.7.H4, CHA.9.541.7.H4(S241P), CHA. 9. 541. 7.vhCDR1, CHA. 9.541. 7.vhCDR2, CHA. 9. 541. 7.vhCDR3, CHA. 9. 541. 7.vlCDR1, CHA. 9.541. 7.vlCDR2 and CHA. 9.541. 7.vhCDR3; and CHA.9.541.8, CHA. 9. 541. 8.VH, CHA. 9. 541. 8.VL, CHA. 9. 541. 8.HC, CHA. 9. 541. 8.LC, CHA. 9. 541. 8.H1, CHA. 9. 541. 8.H2, CHA. 9. 541. 8.H3; CHA.9.541.8.H4, CHA.9.541.8.H4(S241P); CHA. 9. 541. 8vhCDR1, CHA. 9. 541. 8.vhCDR2, CHA. 9. 541. 8.vhCDR3, CHA. 9. 541. 8.vlCDR1, CHA. 9.541. 8.vlCDR2 and CHA. 9.541. 8.vhCDR3.

In the case of scFvs comprising the CDRs of the antibodies above, these are labeled as scFvs that include a scFv comprising a variable heavy domain with the vhCDRs, a linker and a variable light domain with the vhCDRs, again as above in either orientation. Thus the invention includes scFv-CHA.9.536.3.1, scFv-CHA.9.536.3, scFv-CHA.9.536.4, scFv-CHA.9.536.5, scFv-CHA.9.536.7, scFv-CHA.9.536.8, scFv-CHA.9.560.1, scFv-CHA.9.560.3, scFv-CHA.9.560.4, scFv-CHA.9.560.5, scFv-CHA.9.560.6, scFv-CHA.9.560.7, scFv-CHA.9.560.8, scFv-CHA.9.546.1, scFv-CHA.9.547.1, scFv-CHA.9.547.2, scFv-CHA.9.547.3, scFv-CHA.9.547.4, scFv-CHA.9.547.6, scFv-CHA.9.547.7, scFv-CHA.9.547.8, scFv-CHA.9.547.9, scFv-CHA.9.547.13, scFv-CHA.9.541.1, scFv-CHA.9.541.3, scFv-CHA.9.541.4, scFv-CHA.9.541.5, scFv-CHA.9.541.6, scFv-CHA.9.541.7 and scFv-CHA.9.541.8.

In addition, CHA.9.543 binds to TIGIT but does not block the TIGIT-PVR interaction.

As discussed herein, the invention further provides variants of the above components (CPA and CHA), including variants in the CDRs, as outlined above. Thus, the invention provides antibodies comprising a set of 6 CDRs as outlined herein that can contain one, two or three amino acid differences in the set of CDRs, as long as the antibody still binds to TIGIT. Suitable assays for testing whether an anti-TIGIT antibody that contains mutations as compared to the CDR sequences outlined herein are known in the art, such as Biacore assays.

In addition, the invention further provides variants of the above variable heavy and light chains. In this case, the variable heavy chains can be 80%, 90%, 95%, 98% or 99% identical to the "VH" sequences herein, and/or contain from 1, 2, 3, 4, 5, 6, 7, 8, 9, 10 amino acid changes, or more, when Fc variants are used. Variable light chains are provided that can be 80%, 90%, 95%, 98% or 99% identical to the "VL" sequences herein (and in particular CPA.9.086), and/or contain from 1, 2, 3, 4, 5, 6, 7, 8, 9, 10 amino acid changes, or more, when Fc variants are used. In these embodiments, the invention includes these variants as long as the antibody still binds to TIGIT. Suitable assays for testing whether an anti-TIGIT antibody that contains mutations as compared to the CDR sequences outlined herein are known in the art, such as Biacore assays.

Similarly, heavy and light chains are provided that are 80%, 90%, 95%, 98% or 99% identical to the full length "HC" and "LC" sequences herein (and in particular CPA.9.086), and/or contain from 1, 2, 3, 4, 5, 6, 7, 8, 9, 10 amino acid changes, or more, when Fc variants are used. In these embodiments, the invention includes these variants as long as the antibody still binds to TIGIT. Suitable assays for testing whether an anti-TIGIT antibody that contains mutations as compared to the CDR sequences outlined herein are known in the art, such as Biacore assays.

In addition, the framework regions of the variable heavy and variable light chains of either the CPA or CHA antibodies herein can be humanized (or, in the case of the CHA antibodies, "rehumanized", to the extent that alternative humanization methods can be done) as is known in the art (with occasional variants generated in the CDRs as needed), and thus humanized variants of the VH and VL chains of FIG. 53 can be generated (and in particular CPA.9.086). Furthermore, the humanized variable heavy and light domains can then be fused with human constant regions, such as the constant regions from IgG1, IgG2, IgG3 and IgG4 (including IgG4(S241P)).

In particular, as is known in the art, murine VH and VL chains can be humanized as is known in the art, for example, using the IgBLAST program of the NCBI website, as outlined in Ye et al. Nucleic Acids Res. 41:W34-W40 (2013), herein incorporated by reference in its entirety for the humanization methods. IgBLAST takes a murine VH and/or VL sequence and compares it to a library of known human germline sequences. As shown herein, for the humanized sequences generated herein, the databases used were IMGT human VH genes (F+ORF, 273 germline sequences) and IMGT human VL kappa genes (F+ORF, 74 germline sequences). An exemplary five CHA sequences were chosen: CHA.9.536, CHA9.560, CHA.9.546, CHA.9.547 and CHA.9.541 (see FIG. 53). For this embodiment of the humanization, human germline IGHV1-46(allele1) was chosen for all 5 as the acceptor sequence and the human heavy chain IGHJ4(allele1) joining region (J gene). For three of four (CHA.7.518, CHA.7.530, CHA.7.538_1 and CHA.7.538_2), human germline IGKV1-39(allele 1) was chosen as the acceptor sequence and human light chain IGKJ2(allele1) (J gene) was chosen. The J gene was chosen from human joining region sequences compiled at IMGT® the international ImMunoGeneTics information system as www.imgt.org. CDRs were defined according to the AbM definition (see www.bioinfo.org.uk/abs/).

In some embodiments, the anti-TIGIT antibodies of the present invention include anti-TIGIT antibodies wherein the $V_H$ and $V_L$ sequences of different anti-TIGIT antibodies can be "mixed and matched" to create other anti-TIGIT antibodies. TIGIT binding of such "mixed and matched" antibodies can be tested using the binding assays described above. e.g., ELISAs or Biacore assays). In some embodiments, when $V_H$ and $V_L$ chains are mixed and matched, a $V_H$ sequence from a particular $V_H/V_L$ pairing is replaced with a structurally similar $V_H$ sequence. Likewise, in some embodiments, a $V_L$ sequence from a particular $V_H/V_L$ pairing is replaced with a structurally similar $V_L$ sequence. For example, the $V_H$ and $V_L$ sequences of homologous antibodies are particularly amenable for mixing and matching.

Accordingly, the TIGIT antibodies of the invention comprise CDR amino acid sequences selected from the group consisting of (a) sequences as listed herein; (b) sequences that differ from those CDR amino acid sequences specified in (a) by 1, 2, 3, 4, 5, 6, 7, 8, 9, 10 or more amino acid substitutions; (c) amino acid sequences having 90% or greater, 95% or greater, 98% or greater, or 99% or greater sequence identity to the sequences specified in (a) or (b); (d) a polypeptide having an amino acid sequence encoded by a polynucleotide having a nucleic acid sequence encoding the amino acids as listed herein. In particular, the CPA.9.086 antibody can have sequences selected from (a), (b), (c) or (d).

Additionally included in the definition of TIGIT antibodies are antibodies that share identity to the TIGIT antibodies enumerated herein. That is, in certain embodiments, an anti-TIGIT antibody according to the invention comprises heavy and light chain variable regions comprising amino acid sequences that are identical to all or part of the anti-TIGIT amino acid sequences of preferred anti-TIGIT antibodies, respectively, wherein the antibodies retain the desired functional properties of the parent anti-TIGIT antibodies. The percent identity between the two sequences is a function of the number of identical positions shared by the sequences (i.e., % homology=# of identical positions/total # of positions×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent identity between two amino acid sequences can be determined using the algorithm of E. Meyers and W. Miller (*Comput. Appl. Biosci.*, 4:11-17 (1988)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (*J. Mol. Biol.* 48:444-453 (1970)) algorithm which has been incorporated into the GAP program in the GCG software package (available commercially), using either a Blossum 62 matrix or a PAM250 matrix, and a gap weight of 16, 14, 12, 10, 8, 6, or 4 and a length weight of 1, 2, 3, 4, 5, or 6.

Additionally or alternatively, the protein sequences of the present invention can further be used as a "query sequence" to perform a search against public databases to, for example, identify related sequences. Such searches can be performed using the XBLAST program (version 2.0) of Altschul, et al. (1990) *J Mol. Biol.* 215:403-10. BLAST protein searches can be performed with the XBLAST program, score=50, wordlength=3 to obtain amino acid sequences homologous to the antibody molecules according to at least some embodiments of the invention. To obtain gapped alignments for comparison purposes, Gapped BLAST can be utilized as described in Altschul et al., (1997) Nucleic Acids Res. 25(17):3389-3402. When utilizing BLAST and Gapped BLAST programs, the default parameters of the respective programs (e.g., XBLAST and NBLAST) can be used.

In general, the percentage identity for comparison between TIGIT antibodies is at least 75%, at least 80%, at least 90%, with at least about 95, 96, 97, 98 or 99 percent identity being preferred. The percentage identity may be along the whole amino acid sequence, for example the entire heavy or light chain or along a portion of the chains. For example, included within the definition of the anti-TIGIT antibodies of the invention are those that share identity along the entire variable region (for example, where the identity is 95 or 98% identical along the variable regions), or along the entire constant region, or along just the Fc domain. In particular, the invention provides TIGIT antibodies that have at least 75%, at least 80%, at least 90%, with at least about 95, 96, 97, 98 or 99% percent identity being preferred, with the CPA.9.086 antibody.

In addition, also included are sequences that may have the identical CDRs but changes in the framework portions of the variable domain (or entire heavy or light chain). For example, TIGIT antibodies include those with CDRs identical to those shown in FIG. 53 but whose identity along the variable region can be lower, for example 95 or 98% percent identical. In particular, the invention provides TIGIT antibodies that have identical CDRs to CPA.9.086 but with framework regions that are 95 or 98% identical to CPA.9.086.

A. TIGIT Antibodies that Compete for Binding

The present invention provides not only the enumerated antibodies but additional antibodies that compete with the enumerated antibodies (the CPA numbers enumerated herein that specifically bind to TIGIT) to specifically bind to the TIGIT molecule. As is shown in Example 16, the TIGIT antibodies of the invention "bin" into different epitope bins. Among the 44 TIGIT antibodies in the epitope binning study, there are four communities, each having related pairwise blocking patterns, which separate into 12 total discrete bins outlined herein and shown in FIGS. 67 and 68. There are twelve discrete bins outlined herein; 1) BM9-H4, CHA.9.525, CPA.9.081-H4, CHA.9.538, CHA.9.553, CPA.9.069-H4, CHA.9.543, CHA.9.556, CPA.9.077-H4 and CHA.9.561; 2) CHA.9.560 and CHA.9.528; 3) CHA.9.552, CHA.9.521, CHA.9.541, CHA.9.529, CHA.9.519, CHA.9.527 and CHA.9.549; 4) CPA.9.057-H4 and CHA.9.554; 5) CHA.9.546, CPA.9.012-H4, CHA.9.547, CPA.9.013-H4, CPA.9.018-H4, MBSA43-M1, Sino PVR-Fc(ligand), CHA.9.555, PVR-Fc M2A(ligand), BM29-H4, CPA.9.027-H4, CPA.9.049-H4 and CPA.9.053-H4; 6) CPA.9.064-H4; 7) BM26-H4; 8) CPA.9.059-H4; 9) CHA.9.535 and CPA.9.009-H4; 10) CHA.9.536, CHA.9.522 and CPA.9.015-H4; 11) CPA.9.011-H4 and BM8-H4 and 12) CPA.9.071-H4.

Thus, the invention provides anti-TIGIT antibodies that compete for binding with antibodies that are in discrete epitope bins 1 to 12. In a particular embodiment, the invention provides anti-TIGIT antibodies that compete for binding with CPA.9.086 and are at least 95, 96, 97, 98 or 99% identical to CPA.9.086.

Additional antibodies that compete with the enumerated antibodies are generated, as is known in the art and generally outlined below. Competitive binding studies can be done as is known in the art, generally using SPR/Biacore® binding assays, as well as ELISA and cell-based assays.

VIII. PVRIG ANTIBODIES

The present invention provides anti-PVRIG antibodies. (For convenience, "anti-PVRIG antibodies" and "PVRIG antibodies" are used interchangeably). The anti-PVRIG antibodies of the invention specifically bind to human PVRIG, and preferably the ECD of human PVRIG.

Specific binding for PVRIG or a PVRIG epitope can be exhibited, for example, by an antibody having a KD of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the PVRIG antigen or epitope.

However, as shown in the Examples of WO2016/134333, for optimal binding to PVRIG expressed on the surface of NK and T-cells, the antibodies preferably have a KD less 50 nM and most preferably less than 1 nM, with less than 0.1 nM and less than 1 pM and 0.1 pM finding use in the methods of the invention.

Also, specific binding for a particular antigen or an epitope can be exhibited, for example, by an antibody having a KA or Ka for a PVRIG antigen or epitope of at least 20-, 50-, 100-, 500-, 1000-, 5,000-, 10,000- or more times greater for the epitope relative to a control, where KA or Ka refers to an association rate of a particular antibody-antigen interaction.

In some embodiments, the anti-PVRIG antibodies of the invention bind to human PVRIG with a $K_D$ of 100 nM or less, 50 nM or less, 10 nM or less, or 1 nM or less (that is, higher binding affinity), or 1 pM or less, wherein $K_D$ is determined by known methods, e.g. surface plasmon resonance (SPR, e.g. Biacore assays), ELISA, KINEXA, and most typically SPR at 25° or 37° C.

It is important to note that binding affinity for the anti-PVRIG antibodies is surprisingly correlated with activity. A cumulative analysis of screening data shows that the affinity of the anti-PVRIG antibodies of the invention correlated highly with their ability to bind to primary human T cells. More specifically, the antibodies that gave the highest maximum signal on T cells were those with affinities in the picomolar range. Antibodies that had affinities in the low nanomolar range and above gave relatively weak maximum signals on T cells. Thus, the data indicates that the usefulness of anti-PVRIG antibodies for T cell-based immunotherapy can likely be defined, in part, based on their affinity. Reference is made to antibody sequences from WO2016/134333, hereby incorporated by reference and in particular for the anti-PVRIG antigen binding domains outlined in FIG. 38 (depicting sequences that bind PVRIG and block the interaction of PVRIG and PVRL2), FIG. 39 (depicting sequences that bind PVRIG and do not block the interaction of PVRIG and PVRL2), FIG. 40 (depicting CDRs and data from these antibodies), and FIG. 41 (depicting CDRs from hybridomas that bind and block). That is, the Figures and Legends as well as the particular sequences and SEQ ID NOs from all CPA.7 and CHA.7 antibodies (including CDRs, VH and VL and full length sequences) from WO2016/134333 are expressly incorporated herein.

FIG. 45 illustrates the ability of two anti-PVRIG antibodies of different affinities to bind primary CD8 T cells. As shown in FIG. 45, CHA.7.518 has approximately an 8-fold higher affinity than CPA.7.021 (sequence in WO2016/13433) as measured by binding to HEK cells engineered to over-express PVRIG (HEK hPVRIG). Consistent with this, CHA.7.518 has approximately a 13-fold higher affinity than CPA.7.021 as measured by binding to Jurkat cells. The higher affinity of CHA.7.518 did correspond to a greater maximum binding signal from HEK hPVRIG cells, but not Jurkat cells.

In contrast, CHA.7.518 consistently gave a higher maximum binding signal from primary CD8 T cells, as compared to CPA.7.021. This is illustrated in a binding titration experiment where different concentrations of isotype or anti-PVRIG antibodies were added to primary CD8 T cells, and the resultant maximum binding signal measured. In the two donors illustrated (FIG. 45), CHA.7.518 consistently gave a higher maximum signal (geometric mean fluorescence intensity, gMFI) than CPA.7.021 in a titration dependent manner. gMFIr=geometric fluorescence intensity of the antibody of interest/geometric fluorescence intensity of the control antibody. The gMFIr measures the signal the antibody of interest gives relative to an isotype antibody at a fixed concentration of both.

Accordingly, the anti-PVRIG antibodies of the invention have binding affinities (as measured using techniques outlined herein) in the picomolar range, e.g. from 0.1 to 9 pM, with from about 0.2 to about 2 being preferred, and from about 0.2 to about 0.5 being of particular use.

As for the TIGIT antibodies, the PVRIG antibodies are similarly labeled as follows. The antibodies have reference numbers, for example "CHA.7.518.1". This represents the combination of the variable heavy and variable light chains, as depicted in FIG. 3 for example, with the understanding that these antibodies include two heavy chains and two light chains. "CPA. 7.518.1.VH" refers to the variable heavy portion of CPA. 7.518.1, while "CPA.7.518.1.VL" is the variable light chain. "CPA. 7.518.1.vhCDR1", "CPA.7.518.1.vhCDR2", "CPA. 7.518.1.vhCDR3", "CPA. 7.518.1.vlCDR1", "CPA. 7.518.1.vlCDR2", and "CPA. 7.518.1.vlCDR3", refers to the CDRs are indicated. "CPA. 7.518.1.HC" refers to the entire heavy chain (e.g. variable and constant domain) of this molecule, and "CPA. 7.518.1.LC" refers to the entire light chain (e.g. variable and constant domain) of the same molecule. In general, the human kappa light chain is used for the constant domain of each phage (or humanized hybridoma) antibody herein, although in some embodiments the lambda light constant domain is used. "CPA. 7.518.1.H1" refers to a full-length antibody comprising the variable heavy and light domains, including the constant domain of Human IgG1 (hence, the H1; IgG1, IgG2, IgG3 and IgG4 sequences are shown in FIG. 50). Accordingly, "CPA. 7.518.1.H2" would be the CPA. 7.518.1 variable domains linked to a Human IgG2. "CPA. 7.518.1.H3" would be the CPA. 7.518.1 variable domains linked to a Human IgG3, and "CPA. 7.518.1.H4" would be the CPA. 7.518.1 variable domains linked to a Human IgG4. Note that in some cases, the human IgGs may have additional mutations, such are described below, and this can be annotated. For example, in many embodiments, there may be a S241P mutation in the human IgG4, and this can be annotated as "CPA. 7.518.1.H4(S241P)" for example. The human IgG4 sequence with this S241P hinge variant is shown in FIG. 50. Other potential variants are IgG1 (N297A), (or other variants that ablate glycosylation at this site and thus many of the effector functions associated with FcγRIIIa binding), and IgG1(D265A), which reduces binding to FcγR receptors.

The invention further provides variable heavy and light domains as well as full length heavy and light chains.

In some embodiments, the invention provides scFvs that bind to PVRIG comprising a variable heavy domain and a variable light domain linked by an scFv linker as outlined above. The VL and VH domains can be in either orientation, e.g. from N- to C-terminus "VH-linker-VL" or "VL-linker" VH". These are named by their component parts; for example, "scFv-CHA.7.518.1VH-linker-VL" or "scFv-CPA. 7.518.1.VL-linker-VH." Thus, "scFv-CPA. 7.518.1" can be in either orientation.

IX. NUCLEIC ACIDS ENCODING ANTIBODIES

Nucleic acid compositions encoding the antibodies of the invention are also provided, as well as expression vectors containing the nucleic acids and host cells transformed with the nucleic acid and/or expression vector compositions. As will be appreciated by those in the art, the protein sequences depicted herein can be encoded by any number of possible nucleic acid sequences, due to the degeneracy of the genetic code.

The nucleic acid compositions that encode the antibodies will depend on the format of the antibody. For traditional, tetrameric antibodies containing two heavy chains and two light chains are encoded by two different nucleic acids, one encoding the heavy chain and one encoding the light chain. These can be put into a single expression vector or two expression vectors, as is known in the art, transformed into host cells, where they are expressed to form the antibodies of the invention. In some embodiments, for example when scFv constructs are used, a single nucleic acid encoding the variable heavy chain-linker-variable light chain is generally used, which can be inserted into an expression vector for transformation into host cells. The nucleic acids can be put into expression vectors that contain the appropriate transcriptional and translational control sequences, including, but not limited to, signal and secretion sequences, regulatory sequences, promoters, origins of replication, selection genes, etc.

Preferred mammalian host cells for expressing the recombinant antibodies according to at least some embodiments of the invention include Chinese Hamster Ovary (CHO cells), PER.C6, HEK293 and others as is known in the art.

The nucleic acids may be present in whole cells, in a cell lysate, or in a partially purified or substantially pure form. A nucleic acid is "isolated" or "rendered substantially pure" when purified away from other cellular components or other contaminants, e.g., other cellular nucleic acids or proteins, by standard techniques, including alkaline/SDS treatment, CsCl banding, column chromatography, agarose gel electrophoresis and others well known in the art.

To create a scFv gene, the $V_H$- and $V_L$-encoding DNA fragments are operatively linked to another fragment encoding a flexible linker, e.g., encoding the amino acid sequence (Gly4-Ser)3 and others discussed herein, such that the $V_H$ and $V_L$ sequences can be expressed as a contiguous single-chain protein, with the $V_L$ and $V_H$ regions joined by the flexible linker.

X. FORMULATIONS

The therapeutic compositions used in the practice of the foregoing methods (and in particular CHA.7.518.1.H4 (S241P) and CPA.9.086) can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences 16$^{th}$ Edition, A. Osal., Ed., 1980). Acceptable carriers, excipients, or stabilizers are nontoxic to recipients at the dosages and concentrations employed and may include buffers.

In a preferred embodiment, the pharmaceutical composition that comprises the antibodies of the invention may be in a water-soluble form, such as being present as pharmaceutically acceptable salts, which is meant to include both acid and base addition salts. "Pharmaceutically acceptable acid addition salt" refers to those salts that retain the biological effectiveness of the free bases and that are not biologically or otherwise undesirable, formed with inorganic acids and the like. "Pharmaceutically acceptable base addition salts" include those derived from inorganic bases and the like.

Administration of the pharmaceutical composition comprising antibodies of the present invention, preferably in the form of a sterile aqueous solution, may be done in a variety of ways, including, but not limited to subcutaneously and intravenously.

The dosing amounts and frequencies of administration are, in a preferred embodiment, selected to be therapeutically or prophylactically effective. As is known in the art, adjustments for protein degradation, systemic versus localized delivery, and rate of new protease synthesis, as well as the age, body weight, general health, sex, diet, time of administration, drug interaction and the severity of the condition may be necessary, and will be ascertainable with routine experimentation by those skilled in the art.

In order to treat a patient, a therapeutically effective dose of the Fc variant of the present invention may be administered. By "therapeutically effective dose" herein is meant a dose that produces the effects for which it is administered. The exact dose will depend on the purpose of the treatment, and will be ascertainable by one skilled in the art using known techniques.

XI. METHODS FOR USING ANTIBODIES

The antibodies of the invention, including both PVRIG and TIGIT antibodies, can be used in a number of diagnostic and therapeutic applications. In some cases, the decision of which antibody to administer to a patient is done using an evaluation of the expression levels (either gene expression levels or protein expression levels, with the latter being preferred) of sample tumor biopsies to determine whether the sample is overexpressing either TIGIT or PVRIG, or both, to determine what therapeutic antibodies to administer.

A. Diagnostic Uses

Accordingly, the antibodies of the invention also find use in the in vitro or in vivo diagnosis, including imaging, of tumors that over-express either PVRIG or TIGIT, respectively. It should be noted, however, that as discussed herein, both TIGIT and PVRIG, as immuno-oncology target proteins, are not necessarily overexpressed on cancer cells, but rather within the immune infiltrates in the cancer. Thus it is the mechanism of action, e.g. activation of immune cells such as T cells and NK cells, that results in cancer diagnosis. Accordingly, these antibodies can be used to diagnose cancer. Diagnosis using PVRIG antibodies is also outlined in WO 2016/134333, [0434 to 0459], hereby incorporated by reference.

Generally, diagnosis can be done in several ways. In one embodiment, a tissue from a patient, such as a biopsy sample, is contacted with a TIGIT antibody, generally labeled, such that the antibody binds to the endogenous TIGIT. The level of signal is compared to that of normal non-cancerous tissue either from the same patient or a reference sample, to determine the presence or absence of cancer. The biopsy sample can be from a solid tumor, a blood sample (for lymphomas and leukemias such as ALL, T cell lymphoma, etc).

In general, in this embodiment, the anti-TIGIT is labeled, for example with a fluorophore or other optical label, that is detected using a fluorometer or other optical detection system as is well known in the art. In an alternate embodiment, a secondary labeled antibody is contacted with the sample, for example using an anti-human IgG antibody from a different mammal (mouse, rat, rabbit, goat, etc.) to form a sandwich assay as is known in the art. Alternatively, the anti-TIGIT mAb could be directly labeled (i.e. biotin) and detection can be done by a secondary Ab directed to the labeling agent in the art.

Once over-expression of TIGIT is seen, treatment can proceed with the administration of an anti-TIGIT antibody according to the invention as outlined herein.

In other embodiments, in vivo diagnosis is done. Generally, in this embodiment, the anti-TIGIT antibody (including antibody fragments) is injected into the patient and imaging is done. In this embodiment, for example, the antibody is generally labeled with an optical label or an MRI label, such as a gadolinium chelate, radioactive labeling of mAb (including fragments).

In some embodiments, the antibodies described herein are used for both diagnosis and treatment, or for diagnosis alone. When anti-TIGIT antibodies are used for both diagnosis and treatment, some embodiments rely on two different anti-TIGIT antibodies to two different epitopes, such that the diagnostic antibody does not compete for binding with the therapeutic antibody, although in some cases the same antibody can be used for both. For example, this can be done using antibodies that are in different bins, e.g. that bind to different epitopes on TIGIT, such as outlined herein. Thus included in the invention are compositions comprising a diagnostic antibody and a therapeutic antibody, and in some embodiments, the diagnostic antibody is labeled as described herein. In addition, the composition of therapeutic and diagnostic antibodies can also be co-administered with other drugs as outlined herein.

Particularly useful antibodies for use in diagnosis include, but are not limited to these enumerated antibodies, or antibodies that utilize the CDRs with variant sequences, or those that compete for binding with any of the antibodies in FIG. 53.

In many embodiments, a diagnostic antibody is labeled. By "labeled" herein is meant that the antibodies disclosed herein have one or more elements, isotopes, or chemical compounds attached to enable the detection in a screen or diagnostic procedure. In general, labels fall into several classes: a) immune labels, which may be an epitope incorporated as a fusion partner that is recognized by an antibody, b) isotopic labels, which may be radioactive or heavy isotopes, c) small molecule labels, which may include fluorescent and colorimetric dyes, or molecules such as biotin that enable other labeling methods, and d) labels such as particles (including bubbles for ultrasound labeling) or paramagnetic labels that allow body imagining. Labels may be incorporated into the antibodies at any position and may be incorporated in vitro or in vivo during protein expression, as is known in the art.

Diagnosis can be done either in vivo, by administration of a diagnostic antibody that allows whole body imaging as described below, or in vitro, on samples removed from a patient. "Sample" in this context includes any number of things, including, but not limited to, bodily fluids (including, but not limited to, blood, urine, serum, lymph, saliva, anal and vaginal secretions, perspiration and semen), as well as tissue samples such as result from biopsies of relevant tissues.

In addition, as outlined below and in the Examples and Figures, information regarding the protein expression levels of either PVRIG or TIGIT, or both, or PVRIG and PD-1, or TIGIT and PD-1, can be used to determine which antibodies should be administered to a patient.

B. Cancer Treatment

The antibodies of the invention find particular use in the treatment of cancer. In general, the antibodies of the invention are immunomodulatory, in that rather than directly attack cancerous cells, the antibodies of the invention stimulate the immune system, generally by inhibiting the action of the checkpoint receptor (e.g. PVRIG or TIGIT). Thus, unlike tumor-targeted therapies, which are aimed at inhibiting molecular pathways that are crucial for tumor growth and development, and/or depleting tumor cells, cancer immunotherapy is aimed to stimulate the patient's own immune system to eliminate cancer cells, providing long-lived tumor destruction. Various approaches can be used in cancer immunotherapy, among them are therapeutic cancer vaccines to induce tumor-specific T cell responses, and immunostimulatory antibodies (i.e. antagonists of inhibitory receptors=immune checkpoints) to remove immunosuppressive pathways.

Clinical responses with targeted therapy or conventional anti-cancer therapies tend to be transient as cancer cells develop resistance, and tumor recurrence takes place. However, the clinical use of cancer immunotherapy in the past few years has shown that this type of therapy can have durable clinical responses, showing dramatic impact on long term survival. However, although responses are long term, only a small number of patients respond (as opposed to conventional or targeted therapy, where a large number of patients respond, but responses are transient).

By the time a tumor is detected clinically, it has already evaded the immune-defense system by acquiring immunoresistant and immunosuppressive properties and creating an immunosuppressive tumor microenvironment through various mechanisms and a variety of immune cells.

Accordingly, the antibodies of the invention are useful in treating cancer. Due to the nature of an immuno-oncology mechanism of action, the checkpoint receptor (TIGIT or PVRIG) does not necessarily need to be overexpressed on or correlated with a particular cancer type; that is, the goal is to have the antibodies de-suppress T cell and NK cell activation, such that the immune system will go after the cancers.

"Cancer," as used herein, refers broadly to any neoplastic disease (whether invasive or metastatic) characterized by abnormal and uncontrolled cell division causing malignant growth or tumor (e.g., unregulated cell growth.) The term "cancer" or "cancerous" as used herein should be understood to encompass any neoplastic disease (whether invasive, non-invasive or metastatic) which is characterized by abnormal and uncontrolled cell division causing malignant growth or tumor, non-limiting examples of which are described herein. This includes any physiological condition in mammals that is typically characterized by unregulated cell growth. Examples of cancer are exemplified in the working examples and also are described within the specification.

Non-limiting examples of cancer that can be treated using the antibodies of the invention include, but are not limited to, carcinoma, lymphoma, blastoma, sarcoma, and leukemia. More particular examples of such cancers include squamous cell cancer, lung cancer (including small-cell lung cancer, non-small cell lung cancer, adenocarcinoma of the lung, and squamous carcinoma of the lung), cancer of the peritoneum, hepatocellular cancer, gastric or stomach cancer (including gastrointestinal cancer), pancreatic cancer, glioblastoma, cervical cancer, ovarian cancer, melanoma, non melanoma skin cancer (squamous and basal cell carcinoma), liver cancer, bladder cancer, hepatoma, breast cancer, colon cancer, colorectal cancer, endometrial or uterine carcinoma, salivary gland carcinoma, kidney or renal cancer, liver cancer, prostate cancer, vulval cancer, thyroid cancer, hepatic carcinoma and various types of head and neck cancer, as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenström's Macroglobulinemia); chronic lymphocytic leukemia (CLL); acute lymphoblastic leukemia (ALL); Hairy cell leukemia; chronic myeloblastic leukemia; multiple myeloma and post-transplant lymphoproliferative disorder (PTLD).

As shown in the Examples of WO2016/134333, PVRIG is over expressed and/or correlates with tumor lymphocyte infiltration (as demonstrated by correlation to CD3, CD4, CD8 and PD-1 expression) in a number of different tumors of various origins, and thus is useful in treating any cancer, including but not limited to, prostate cancer, liver cancer (HCC), colorectal cancer, ovarian cancer, endometrial cancer, breast cancer, pancreatic cancer, stomach cancer, cervical cancer, head and neck cancer, thyroid cancer, testis cancer, urothelial cancer, lung cancer, melanoma, non melanoma skin cancer (squamous and basal cell carcinoma), glioma, renal cancer (RCC), lymphoma (non-Hodgkins' lymphoma (NHL) and Hodgkin's lymphoma (HD)), Acute myeloid leukemia (AML), T cell Acute Lymphoblastic Leukemia (T-ALL), Diffuse Large B cell lymphoma, testicular germ cell tumors, mesothelioma, and esophageal cancer.

In particular, CHA.7.518.1H4(S241P) finds use in treating prostate cancer, liver cancer (HCC), colorectal cancer, ovarian cancer, endometrial cancer, breast cancer, pancreatic cancer, stomach cancer, cervical cancer, head and neck cancer, thyroid cancer, testis cancer, urothelial cancer, lung cancer, melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma, bladder cancer and esophageal cancer.

In particular, CHA.7.538.1.2.H4(S241P) finds use in treating prostate cancer, liver cancer (HCC), colorectal cancer, ovarian cancer, endometrial cancer, breast cancer, pancreatic cancer, stomach cancer, cervical cancer, head and neck cancer, thyroid cancer, testis cancer, urothelial cancer, lung cancer, melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma, bladder cancer and esophageal cancer.

In particular, CPA.9.086H4(S241P) finds use in treating prostate cancer, liver cancer (HCC), colorectal cancer, ovarian cancer, endometrial cancer, breast cancer, pancreatic cancer, stomach cancer, cervical cancer, head and neck cancer, thyroid cancer, testis cancer, urothelial cancer, lung cancer, melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma, bladder cancer and esophageal cancer.

In particular CPA.9.083H4(S241P) finds use in treating prostate cancer, liver cancer (HCC), colorectal cancer, ovarian cancer, endometrial cancer, breast cancer, pancreatic cancer, stomach cancer, cervical cancer, head and neck cancer, thyroid cancer, testis cancer, urothelial cancer, lung cancer, melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma, bladder cancer and esophageal cancer.

In particular CHA.9.547.7.H4(S241P) finds use in treating prostate cancer, liver cancer (HCC), colorectal cancer, ovarian cancer, endometrial cancer, breast cancer, pancreatic cancer, stomach cancer, cervical cancer, head and neck cancer, thyroid cancer, testis cancer, urothelial cancer, lung cancer, melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma, bladder cancer and esophageal cancer.

In particular CHA.9.547.13.H4(S241P) finds use in treating prostate cancer, liver cancer (HCC), colorectal cancer, ovarian cancer, endometrial cancer, breast cancer, pancreatic cancer, stomach cancer, cervical cancer, head and neck cancer, thyroid cancer, testis cancer, urothelial cancer, lung cancer, melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma, bladder cancer and esophageal cancer.

C. TIGIT Antibody Monotherapy

The TIGIT antibodies of the invention find particular use in the treatment of cancer as a monotherapy. Due to the nature of an immuno-oncology mechanism of action, TIGIT does not necessarily need to be overexpressed on or correlated with a particular cancer type; that is, the goal is to have the anti-TIGIT antibodies de-suppress T cell and NK cell activation, such that the immune system will go after the cancers.

While any anti-TIGIT antibody of FIG. 53 find us in the treatment of cancer (including the activation of T cells as outlined below), CPA.9.086.H4(S241P), CPA.9.083.H4 (S241P), CHA.9.547.7.H4(S241P), and CHA.9.547.13.H4 (S241P), find particular use in some embodiments.

D. PVRIG Antibody Monotherapy

The PVRIG antibodies of the invention find particular use in the treatment of cancer as a monotherapy. Due to the nature of an immuno-oncology mechanism of action, TIGIT does not necessarily need to be overexpressed on or correlated with a particular cancer type; that is, the goal is to have the anti-TIGIT antibodies de-suppress T cell and NK cell activation, such that the immune system will go after the cancers.

In particular, CHA.7.518.1H4(S241P) finds use as a monotherapy.

Similarly, in particular, CHA.7.538.1.2.H4(S241P) finds use as a monotherapy in treating prostate cancer, liver cancer (HCC), colorectal cancer, ovarian cancer, endometrial cancer, breast cancer, pancreatic cancer, stomach cancer, cervical cancer, head and neck cancer, thyroid cancer, testis cancer, urothelial cancer, lung cancer, melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma, bladder cancer and esophageal cancer.

E. Combination Therapies

As is known in the art, combination therapies comprising a therapeutic antibody targeting an immunotherapy target and an additional therapeutic agent, specific for the disease condition, are showing great promise. For example, in the area of immunotherapy, there are a number of promising combination therapies using a chemotherapeutic agent (either a small molecule drug or an anti-tumor antibody) or with an immuno-oncology antibody.

The terms "in combination with" and "co-administration" are not limited to the administration of said prophylactic or therapeutic agents at exactly the same time. Instead, it is meant that the antibody and the other agent or agents are administered in a sequence and within a time interval such that they may act together to provide a benefit that is increased versus treatment with only either the antibody of the present invention or the other agent or agents. It is preferred that the antibody and the other agent or agents act additively, and especially preferred that they act synergistically. Such molecules are suitably present in combination in amounts that are effective for the purpose intended. The skilled medical practitioner can determine empirically, or by considering the pharmacokinetics and modes of action of the agents, the appropriate dose or doses of each therapeutic agent, as well as the appropriate timings and methods of administration.

Accordingly, the antibodies of the present invention may be administered concomitantly with one or more other therapeutic regimens or agents. The additional therapeutic regimes or agents may be used to improve the efficacy or safety of the antibody. Also, the additional therapeutic regimes or agents may be used to treat the same disease or a comorbidity rather than to alter the action of the antibody. For example, an antibody of the present invention may be administered to the patient along with chemotherapy, radiation therapy, or both chemotherapy and radiation therapy.

1. TIGIT Antibodies with Chemotherapeutic Small Molecules

The TIGIT antibodies of the present invention may be administered in combination with one or more other prophylactic or therapeutic agents, including but not limited to cytotoxic agents, chemotherapeutic agents, cytokines, growth inhibitory agents, anti-hormonal agents, kinase inhibitors, anti-angiogenic agents, cardioprotectants, immunostimulatory agents, immunosuppressive agents, agents that promote proliferation of hematological cells, angiogenesis inhibitors, protein tyrosine kinase (PTK) inhibitors, or other therapeutic agents.

In this context, a "chemotherapeutic agent" is a chemical compound useful in the treatment of cancer. Examples of chemotherapeutic agents include alkylating agents such as thiotepa and cyclosphosphamide, alkyl sulfonates such as busulfan, improsulfan and piposulfan; aziridines such as benzodopa, carboquone, meturedopa, and uredopa; ethylenimines and methylamelamines including altretamine, triethylenemelamine, triethylenephosphoramide, triethylenethiophosphoramide and trimethylolomelamine; acetogenins (especially bullatacin and bullatacinone); delta-9-tetrahydrocannabinol (dronabinol, MARINOL'); beta-lapachone; lapachol; colchicines; betulinic acid; a camptothecin (including the synthetic analogue topotecan (HYCAMTN®), CPT-11 (irinotecan, CAMPTOSAR®), acetylcamptothecin, scopolectin, and 9-aminocamptothecin); bryostatin; callystatin; CC-1065 (including its adozelesin, carzelesin and bizelesin synthetic analogues); podophyllotoxin; podophyllinic acid; teniposide; cryptophycins (particularly cryptophycin 1 and cryptophycin 8); dolastatin; duocarmycin (including the synthetic analogues, KW-2189 and CB1-

TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosoureas such as carmustine, chlorozotocin, fotemustine, lomustine, nimustine, and ranimnustine; antibiotics such as the enediyne antibiotics (e.g., calicheamicin, especially calicheamicin gammaII and calicheamicin omegaII (see, e.g., Agnew, Chem Intl. Ed. Engl., 33: 183-186 (1994)); dynemicin, including dynemicin A; an esperamicin; as well as neocarzinostatin chromophore and related chromoprotein enediyne antiobiotic chromophores), adacinomysins, actinomycin, authramycin, azaserine, bleomycin, cactinomycin, carabicin, carminomycin, carzinophilin, chromomycins, dactinomycin, daunorubicin, detorubicin, 6-diazo-5-oxo-L-norleucine, doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, porfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elfornithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; 2-ethylhydrazide; procarbazine; PSK® polysaccharide complex (JHS Natural Products, Eugene, Oreg.); razoxane; rhizoxin; sizofiran; spirogermanium; tenuazonic acid; triaziquone; 2,2',2"-trichlorotriethylamine; trichothecenes (especially T-2 toxin, verracurin A, roridin A and anguidine); urethan; vindesine (ELDISINE®, FILDESIN®); dacarbazine; mannomustine; mitobronitol; mitolactol; pipobroman; gacytosine; arabinoside ("Ara-C"); thiotepa; taxoids, e.g., paclitaxel (TAXOL®; Bristol-Myers Squibb Oncology, Princeton, N.J.), ABRAXANE®, cremophor-free, albumin-engineered nanopartide formulation of paclitaxel (American Pharmaceutical Partners, Schaumberg, Ill.), and docetaxel (TAXOTERE®; Rhone-Poulenc Rorer, Antony, France); chlorambucil; gemcitabine (GEMZARM®); 6-thioguanine; mercaptopurine; methotrexate; platinum analogs such as cisplatin and carboplatin; vinblastine (VELBAN®); platinum; etoposide (VP-16); ifosfamide; mitoxantrone; vincristine (ONCOVIN®); oxaliplatin; leucovovin; vinorelbine (NAVELBINE®); novantrone; edatrexate; daunomycin; aminopterin; ibandronate; topoisomerase inhibitor RFS 2000; difluoromethylornithine (DMFO); retinoids such as retinoic acid; capecitabine (XELODA®); pharmaceutically acceptable salts, acids or derivatives of any of the above; as well as combinations of two or more of the above such as CHOP, an abbreviation for a combined therapy of cyclophosphamide, doxorubicin, vincristine, and prednisolone; CVP, an abbreviation for a combined therapy of cyclophosphamide, vincristine, and prednisolone; and FOLFOX, an abbreviation for a treatment regimen with oxaliplatin (ELOXATIN®) combined with 5-FU and leucovorin.

According to at least some embodiments, the anti TIGIT immune molecules could be used in combination with any of the known in the art standard of care cancer treatment (as can found on the World Wide Web at cancer.gov/cancertopics).

Thus, in some cases, the anti-PVRIG antibodies outlined herein (particularly including CHA.7.538.1.2.H4(S241P) or CHA.7.518.1.H4(S241P)) can be combined with chemotherapeutic agents. Similarly, the anti-TIGIT antibodies outlined herein (particularly including CPA.9.086H4 (S241P), CPA.9.083H4 (S241P) and CHA. 9. 547. 13.H4(S241P)) can be combined with chemotherapeutic agents.

In addition, the anti-PVRIG and anti-TIGIT antibodies of the invention can also be administered with other checkpoint inhibitors or activators.

2. TIGIT and Checkpoint Antibody Combination Therapy

As shown herein, the TIGIT antibodies of the invention can be combined with one of a number of checkpoint receptor antibodies. In some embodiments, a patient's tumor may be evaluated for expression of receptors and the results then used to inform a clinician as to which antibodies to administer: PVRIG and PD-1, TIGIT and PD-1 or TIGIT and PVRIG. These assays are described below.

a. Anti-TIGIT Antibodies in Combination with Anti-PD-1 Antibodies

In one embodiment, the invention provides combinations of the anti-TIGIT antibodies of the invention and anti-PD-1 antibodies.

In one embodiment, a biopsy is taken from a tumor from a patient with cancer, and dissociated as is known in the art for FACS analysis. The cells are stained with labeled antibodies to (1) TIGIT (for example using any described herein or others in the art such as MBSA43); (2) PD-1 (for example using those known in the art including EH12.2H7, Keytruda®, Opdivo®, etc.); (3) PD-L1 (for example using those known in the art such as BM-1 outlined herein) and (4) PVR (for example using those known in the art such as SKII.4); and (5) an isotype control antibody. FACS is done, and for each receptor, the percentage of the cells expressing the receptor relative to the control antibody is calculated. If the percentage of positive cells for TIGIT, PD-1, PD-1 and PVR is ≥1% for all 4 receptors, then the patient is treated with antibodies to TIGIT and PD-1 as outlined herein.

Accordingly, the invention provides combinations of the anti-TIGIT antibodies of the invention and anti-PD-1 antibodies. There are two approved anti-PD-1 antibodies, pembrolizumab (Keytruda®) and nivolumab (Opdivo®) and many more in development which can be used in combination with the anti-TIGIT antibodies of the invention.

Accordingly, the invention provides the specific combinations of: CPA.9.083.H4(S241P) (as shown in FIG. 53B) with pembrolizumab; CPA.9.083.H4(S241P) as shown in FIG. 53B with nivolumab; CPA.9.086.H4(S241P) as shown in FIG. 53A with pembrolizumab; CPA.9.086.H4(S241P) as shown in FIG. 53A with nivolumab; CHA.9.547.7H4 (S241P) with pembrolizumab; CHA.9.547.7H4(S241P with nivolumab; CHA.9.547.13.H4(S241P) with pembrolizumab and CHA.9.547.13.H4(S241P) with nivolumab. (Reference is made to the sequence listing).

b. Anti-TIGIT Antibodies in Combination with Anti-CTLA-4 Antibodies

In another embodiment, the invention provides combinations of the anti-TIGIT antibodies of the invention and anti-CTLA-4 antibodies. There are two approved anti-CTLA-4 antibodies, ipilimumab (Yervoy®), and tremelimumab, as well as others in development, which can be used in combination with the anti-TIGIT antibodies of the invention.

Accordingly, the invention provides the specific combinations of: CPA.9.083.H4(S241P) with ipilimumab; CPA.9.083.H4(S241P) with tremelimumab; CPA.9.086.H4(S241P) with ipilimumab; CPA.9.086.H4(S241P) with tremelimumab; CHA.9.547.7H4(S241P) with ipilimumab; CHA.9.547.7H4(S241P) with tremelimumab; CHA.9.547.13.H4(S241P) with ipilimumab and CHA.9.547.13.H4(S241P) with tremelimumab.

c. Anti-TIGIT Antibodies in Combination with Anti-PD-L1 Antibodies

In another embodiment, the invention provides combinations of the anti-TIGIT antibodies of the invention and anti-PD-L1 antibodies. There are three approved anti-PD-L1 antibodies, atezolizumab (TECENTRIQ®), avelumab (BAVENCIO®), and durvalumab (IMFINZI™), as well as other anti-PD-L1 antibodies in development, which can be used in combination with the anti-TIGIT antibodies of the invention.

Accordingly, the invention provides the specific combinations of: CPA.9.083.H4(S241P) with atezolizumab; CPA.9.083.H4(S241P) with avelumab; CPA.9.083.H4(S241P) with durvalumab; CPA.9.086.H4(S241P) with atezolizumab; CPA.9.086.H4(S241P) with avelumab; CPA.9.086.H4(S241P) with durvalumab; CHA.9.547.7H4(S241P) with atezolizumab; CHA.9.547.7H4(S241P) with avelumab; CHA.9.547.7H4(S241P) with durvalumab; CHA.9.547.13.H4(S241P) with atezolizumab; CHA.9.547.13.H4(S241P) with avelumab; and CHA.9.547.13.H4(S241P) with durvalumab.

d. Anti-TIGIT Antibodies in Combination with Anti-LAG-3 Antibodies

In another embodiment, the invention provides combinations of the anti-TIGIT antibodies of the invention and anti-LAG-3 antibodies. There are several anti-LAG-3 antibodies in development, including BMS-986016 (see, International Patent Application No. WO2010/019570A2, incorporated by reference herein in its entirety) GSK2831781 (see, US Patent Applic. No. 2016/0017037A, incorporated by reference herein in its entirety), and Merck clones 22D2, 11C9, 4A10, and/or 19E8 (see, WO2016/028672A1, incorporated by reference herein in its entirety) and GSK2831781 as well as others in development, which can be used in combination with the anti-TIGIT antibodies of the invention.

Accordingly, the invention provides the specific combinations of: CPA.9.083.H4(S241P) with BMS-986016; CPA.9.083.H4(S241P) with GSK2831781; CPA.9.086.H4(S241P) with BMS-986016; CPA.9.086.H4(S241P) with GSK2831781; CHA.9.547.7H4(S241P) with BMS-986016; CHA.9.547.7H4(S241P) with GSK2831781; CHA.9.547.13.H4(S241P) with BMS-986016 and CHA.9.547.13.H4(S241P) with GSK2831781.

Accordingly, the invention also provides the specific combinations of: CPA.9.083.H4(S241P) with Merck clones 22D2, 11C9, and/or 4A10; CPA.9.086.H4(S241P) with Merck clones 22D2, 11C9, and/or 4A10; CHA.9.547.7H4(S241P) with Merck clones 22D2, 11C9, and/or 4A10; CHA.9.547.13.H4(S241P) with Merck clones 22D2, 11C9, and/or 4A10.

e. Anti-TIGIT Antibodies in Combination with Anti-TIM-3 Antibodies

In another embodiment, the invention provides combinations of the anti-TIGIT antibodies of the invention and anti-TIM-3 antibodies. There is at least one anti-TIM-3 antibody in development, TSR-022, as well as others in development, which can be used in combination with the anti-TIGIT antibodies of the invention.

Accordingly, the invention provides the specific combinations of: CPA.9.083.H4(S241P) with TSR-022; CPA.9.086.H4(S241P) with TSR-0226; CHA.9.547.7H4(S241P) with TSR-022; and CHA.9.547.13.H4(S241P) with TSR-022.

f. Anti-TIGIT Antibodies in Combination with Anti-BTLA Antibodies

In another embodiment, the invention provides combinations of the anti-TIGIT antibodies of the invention and anti-BTLA antibodies, see WO2011/014438, hereby incorporated by reference in its entirety, and particularly for the CDRs and full length sequences of the anti-BTLA antibodies disclosed therein. Accordingly, the invention provides the specific combinations of: CPA.9.083.H4(S241P) with an anti-BTLA antibody; CPA.9.086.H4(S241P) with an anti-BTLA antibody; CHA.9.547.7H4(S241P) with an anti-BTLA antibody; and CHA.9.547.13.H4(S241P with an anti-BTLA antibody.

g. TIGIT Antibodies with Anti-Tumor Antibodies

In some embodiments, the anti-TIGIT antibodies of the invention are co-administered with antibodies that, unlike immuno-oncology/checkpoint inhibitors that generally act on the immune system to increase a patient's native immune response, instead are directed against a specific tumor target antigen (TTA). There are a wide number of anti-TTA antibodies either approved or in development that can be combined with the present TIGIT antibodies. Currently approved antibodies, include, but are not limited to, cetuximab, panitumumab, nimotuzumab (all to EGFR), rituximab (CD20), trastuzumab and pertuzumab (HER2), alemtuzumab (CD52), bevacizumab (VEGF), ofatumumab (CD20), denosumab (RANK ligand), brentuximab (CD30), daratumumab (CD38), ibritumomab (CD20) and ipilimumab (CTLA-4). Specific target oncology antibodies in clinical trials that can be combined with the anti-TIGIT antibodies herein include, but are not limited to, anti-CTLA4 mAbs, such as ipilimumab, tremelimumab; anti-PD-1 such as nivolumab BMS-936558/MDX-1106/ONO-4538, AMP224, CT-011, MK-3475, anti-PDL-1 antagonists such as BMS-936559/MDX-1105, MEDI4736, RG-7446/MPDL3280A; Anti-LAG-3 such as IMP-321), anti-TIM-3, anti-BTLA, anti-B7-H4, anti-B7-H3, Anti-VISTA; Agonistic antibodies targeting immunostimulatory proteins, including anti-CD40 mAbs such as CP-870,893, lucatumumab, dacetuzumab; anti-CD137 mAbs such as BMS-663513 urelumab (anti-4-1BB; see, for example, U.S. Pat. Nos. 7,288,638 and 8,962,804, incorporated by reference herein in their entireties); PF-05082566 utomilumab (see, for example, U.S. Pat. Nos. 8,821,867; 8,337,850; and 9,468,678, as well as International Patent Application Publication No. WO 2012/032433, incorporated by reference herein in their entireties); anti-OX40 mAbs, such as anti-OX40 (see, for example, WO2006/029879 or WO2010096418, incorporated by reference herein in their entireties); anti-GITR mAbs such as TRX518 (see, for example, U.S. Pat. No. 7,812,135, incorporated by reference herein in its entirety); anti-CD27 mAbs, such as varlilumab CDX-1127 (see, for example, WO 2016/145085 and U.S. Patent Publication Nos. US 2011/0274685 and US 2012/0213771, incorporated by reference herein in their entireties) anti-ICOS mAbs (for example, MEDI-570, JTX-2011, and anti-TIM3 antibodies (see, for example, WO 2013/006490 or U.S. Patent Publication No US 2016/0257758, incorporated by reference herein in their entireties), as well as monoclonal antibodies to prostate cancer, ovarian cancer, breast cancer, endometrial cancer, multiple myeloma, melanoma, lymphomas, lung cancers including small cell lung cancer, kidney cancer, colorectal cancer, pancreatic cancer, gastric cancer, brain cancer, (see generally www.clinicaltrials.gov).

3. PVRIG and PD-1 Combination Therapy

As shown herein, the PVRIG antibodies of the invention can be combined with one of a number of checkpoint receptor antibodies.

a. Anti-PVRIG Antibodies in Combination with Anti-PD-1 Antibodies

In another embodiment, the invention provides combinations of the anti-PVRIG antibodies of the invention and anti-PD-1 antibodies.

In one embodiment, a biopsy is taken from a tumor from a patient with cancer, and dissociated as is known in the art for FACS analysis. The cells are stained with labeled antibodies to (1) PVRIG (generally using CHA.7.518.1H4 (S241P), for example, although any outlined in WO2016/134333 (specifically including any that bind, even if they don't block) or WO2017/041004) can be used); (2) PD-1 (for example using those known in the art including EH12.2H7, Keytruda®, Opdivo®, etc.); (3) PD-L1 (for example using those known in the art such as BM-1 outlined herein) and (4) PVRL2 (for example using those known in the art such as TX11); and (5) an isotype control antibody. FACS is done, and for each receptor, the percentage of the cells expressing the receptor relative to the control antibody is calculated. If the percentage of positive cells for PVRIG, PD-1, PD-1 and PVRL2 is ≥1% for all 4 receptors, then the patient is treated with antibodies to PVRIG and PD-1 as outlined herein.

There are two approved anti-PD-1 antibodies, pembrolizumab (Keytruda®) and nivolumab (Opdivo®) and many more in development which can be used in combination with the anti-PVRIG antibodies of the invention.

Accordingly, the invention provides the specific combinations of: CHA.7.518.1.H4(S241P) (as shown in FIG. 3) with pembrolizumab; CHA.7.518.1.H4(S241P) as shown in FIG. 3 with nivolumab; CHA.7.538.1.2.H4(S241P) as shown in FIG. 3 with pembrolizumab and CHA.7.538.1.2.H4(S241P) as shown in with nivolumab.

b. Anti-PVRIG Antibodies in Combination with Anti-CTLA-4 Antibodies

In another embodiment, the invention provides combinations of the anti-PVRIG antibodies of the invention and anti-CTLA-4 antibodies. There are two approved anti-CTLA-4 antibodies, ipilimumab (Yervoy®), and tremelimumab, as well as others in development, which can be used in combination with the anti-TIGIT antibodies of the invention.

Accordingly, the invention provides the specific combinations of: CHA.7.518.1.H4(S241P) with ipilimumab; CHA.7.518.1.H4(S241P) with tremelimumab; CHA.7.538.1.2.H4(S241P) with ipilimumab and CHA.7.538.1.2.H4(S241P) with tremelimumab.

c. Anti-PVRIG Antibodies in Combination with Anti-PD-L1 Antibodies

In another embodiment, the invention provides combinations of the anti-PVRIG antibodies of the invention and anti-PD-L1 antibodies. There are three approved anti-PD-L1 antibodies, atezolizumab (TECENTRIQ®), avelumab (BAVENCIO®), and durvalumab, as well as other anti-PD-L1 antibodies in development, which can be used in combination with the anti-TIGIT antibodies of the invention.

Accordingly, the invention provides the specific combinations of: CHA.7.518.1.H4(S241P) with atezolizumab; CPA.7518.1.H4(S241P) with avelumab; CHA.7.518.1.H4 (S241P) with durvalumab; CHA.7.538.1.2.H4(S241P) with atezolizumab; CHA.7.538.1.2.H4(S241P) with avelumab and CHA.7.538.1.2.H4(S241P) with durvalumab.

d. Anti-PVRIG Antibodies in Combination with Anti-LAG-3 Antibodies

In another embodiment, the invention provides combinations of the anti-PVRIG antibodies of the invention and anti-LAG-3 antibodies. There are several anti-LAG-3 antibodies in development, including BMS-986016 (see, International Patent Application No. WO2010/019570A2, incorporated by reference herein in its entirety) GSK2831781 (see, US Patent Applic. No. 2016/0017037A, incorporated by reference herein in its entirety), and Merck clones 22D2, 11C9, 4A10, and/or 19E8 (see, WO2016/028672A1, incorporated by reference herein in its entirety) and GSK2831781 as well as others in development, which can be used in combination with the anti-PVRIG antibodies of the invention.

Accordingly, the invention provides the specific combinations of: CHA.7.518.1.H4(S241P) with BMS-986016; CHA.7.518.1.H4(S241P) with GSK2831781; CHA.7.538.1.2.H4(S241P) with BMS-986016 and CHA.7.538.1.2.H4(S241P) with GSK2831781.

Accordingly, the invention also provides the specific combinations of: CHA.7.518.1.H4(S241P) with Merck clones 22D2, 11C9, and/or 4A10 and CHA.7.538.1.2.H4 (S241P) with Merck clones 22D2, 11C9, and/or 4A10.

e. Anti-PVRIG Antibodies in Combination with Anti-TIM-3 Antibodies

In another embodiment, the invention provides combinations of the anti-PVRIG antibodies of the invention and anti-TIM-3 antibodies. There is at least one anti-TIM-3 antibody in development, TSR-022, as well as others in development, which can be used in combination with the anti-PVRIG antibodies of the invention.

Accordingly, the invention provides the specific combinations of: CHA.7.518.1.H4(S241P) with TSR-022 and CHA.7.538.1.2.H4(S241P) with TSR-0226.

f. Anti-PVRIG Antibodies in Combination with Anti-BTLA Antibodies

In another embodiment, the invention provides combinations of the anti-PVRIG antibodies of the invention and anti-BTLA antibodies, see WO2011/014438, hereby incorporated by reference in its entirety, and particularly for the CDRs and full length sequences of the anti-BTLA antibodies disclosed therein. Accordingly, the invention provides the specific combinations of: CHA.7.518.1.H4(S241P) with an anti-BTLA antibody and CHA.7.538.1.2.H4(S241P) with an anti-BTLA antibody.

g. PVRIG Antibodies with Anti-Tumor Antibodies

In some embodiments, the anti-PVRIG antibodies of the invention are co-administered with antibodies that, unlike immuno-oncology/checkpoint inhibitors that generally act on the immune system to increase a patient's native immune response, instead are directed against a specific tumor target antigen (TTA). There are a wide number of anti-TTA antibodies either approved or in development that can be combined with the present PVRIG antibodies, including CHA.7.518.1.H4(S241P) and CHA.7.538.1.2.H4(S241P). Currently approved antibodies, include, but are not limited to, cetuximab, panitumumab, nimotuzumab (all to EGFR), rituximab (CD20), trastuzumab and pertuzumab (HER2), alemtuzumab (CD52), bevacizumab (VEGF), ofatumumab (CD20), denosumab (RANK ligand), brentuximab (CD30), daratumumab (CD38), ibritumomab (CD20) and ipilimumab (CTLA-4). Specific target oncology antibodies in clinical trials that can be combined with the anti-PVRIG antibodies herein include, but are not limited to, anti-CTLA4 mAbs, such as ipilimumab, tremelimumab; anti-PD-1 such as nivolumab BMS-936558/MDX-1106/ONO-4538, AMP224, CT-011, MK-3475, anti-PDL-1 antagonists such as BMS-936559/MDX-1105, MEDI4736, RG-7446/ MPDL3280A; Anti-LAG-3 such as IMP-321), anti-TIM-3, anti-BTLA, anti-B7-H4, anti-B7-H3, Anti-VISTA; Agonistic antibodies targeting immunostimulatory proteins, including anti-CD40 mAbs such as CP-870,893, lucatumumab, dacetuzumab; anti-CD137 mAbs such as BMS-663513 urelumab (anti-4-1BB; see, for example, U.S. Pat. Nos. 7,288, 638 and 8,962,804, incorporated by reference herein in their entireties); PF-05082566 utomilumab (see, for example, U.S. Pat. Nos. 8,821,867; 8,337,850; and 9,468,678, as well as International Patent Application Publication No. WO 2012/032433, incorporated by reference herein in their entireties); anti-OX40 mAbs, such as anti-OX40 (see, for example, WO2006/029879 or WO2010096418, incorporated by reference herein in their entireties); anti-GITR mAbs such as TRX518 (see, for example, U.S. Pat. No. 7,812,135, incorporated by reference herein in its entirety); anti-CD27 mAbs, such as varlilumab CDX-1127 (see, for example, WO 2016/145085 and U.S. Patent Publication Nos. US 2011/0274685 and US 2012/0213771, incorporated by reference herein in their entireties) anti-ICOS mAbs (for example, MEDI-570, JTX-2011, and anti-TIM3 antibodies (see, for example, WO 2013/006490 or U.S. Patent Publication No US 2016/0257758, incorporated by reference herein in their entireties), as well as monoclonal antibodies to prostate cancer, ovarian cancer, breast cancer, endometrial cancer, multiple myeloma, melanoma, lymphomas, lung cancers including small cell lung cancer, kidney cancer, colorectal cancer, pancreatic cancer, gastric cancer, brain cancer, (see generally www.clinicaltrials.gov).

4. PVRIG and TIGIT Combination Therapy

There are specific combinations of anti-TIGIT and anti-PVRIG antibodies that find use in particular embodiments.

In one embodiment, a biopsy is taken from a tumor from a patient with cancer, and dissociated as is known in the art for FACS analysis. The cells are stained with labeled antibodies to (1) PVRIG (generally using CHA.7.518.1H4 (S241P), for example, although any outlined in WO2016/ 134333 (specifically including any that bind, even if they don't block) or WO2017/041004) can be used); (2) TIGIT (for example using any described herein or others in the art such as MBSA43); (3) PVR (for example using those known in the art such as SKII.4) and (4) PVRL2 (for example using those known in the art such as TX11); and (5) an isotype control antibody. FACS is done, and for each receptor, the percentage of the cells expressing the receptor relative to the control antibody is calculated. If the percentage of positive cells for PVRIG, TIGIT, PVR and PVRL2 is ≥1% for all 4 receptors, then the patient is treated with antibodies to PVRIG and TIGIT. Preferred combinations in this regard are CHA.7.518.1.H4(S241P) and CPA.9.086.

In one embodiment, antibodies containing the CDR sets from the anti-TIGIT antibody CPA.9.086 are combined with antibodies containing the CDR sets from the anti-PVRIG antibody CHA.7.518.1. In a particular embodiment, antibodies containing the VH and VL sequences from the anti-TIGIT antibody CPA.9.086 are combined with antibodies containing the VL and VL from the anti-PVRIG antibody CHA.7.518.1. In one embodiment, CPA.9.086.H4(S241P) as shown in FIG. 53 is combined with CHA.7.518.1H4 (S241P) as shown in FIG. 3.

In one embodiment, antibodies containing the CDR sets from the anti-TIGIT antibody CPA.9.083 are combined with antibodies containing the CDR sets from the anti-PVRIG antibody CHA.7.518.1. In a particular embodiment, antibodies containing the VH and VL sequences from the anti-TIGIT antibody CPA.9.083 are combined with antibodies containing the VL and VL from the anti-PVRIG antibody CHA.7.518.1. In one embodiment, CPA.9.086.H4(S241P) is combined with CHA.7.518.1H4(S241P).

In one embodiment, antibodies containing the CDR sets from the anti-TIGIT antibody CPA.9.086 are combined with antibodies containing the CDR sets from the anti-PVRIG antibody CHA.7.538.1.2.H4(S241P). In a particular embodiment, antibodies containing the VH and VL sequences from the anti-TIGIT antibody CPA.9.086 are combined with antibodies containing the VL and VL from the anti-PVRIG antibody CHA.7.538.1.2.H4(S241P). In one embodiment, CPA.9.086.H4(S241P) is combined with CHA.7.538.1.2.H4(S241P).

In one embodiment, CHA.518.1.H4(S241P) is combined with an anti-TIGIT antibody as recited in the sequence listing (with reference to all the antibodies listed in FIG. 4 of U.S. Ser. No. 62/513,916), specifically CPA.9.018, CPA.9.027, CPA.9.049, CPA.9.057, CPA.9.059, CPA.9.083, CPA.9.086, CPA.9.089, CPA.9.093, CPA.9.101, CPA.9.103, CHA.9.536.1, CHA.9.536.3, CHA.9.536.4, CHA.9.536.5, CHA.9.536.6, CHA.9.536.7, CHA.9.536.8, CHA.9.560.1, CHA.9.560.3, CHA.9.560.4, CHA.9.560.5, CHA.9.560.6, CHA.9.560.7, CHA.9.560.8, CHA.9.546.1, CHA.9.546.1, CHA.9.547.2, CHA.9.547.3, CHA.9.547.4, CHA.9.547.6, CHA.9.547.7, CHA.9.547.8, CHA.9.547.9, CHA.9.547.13, CHA.9.541.1, CHA.9.541.3. CHA.9.541.4. CHA.9.541.5, CHA.9.541.6. CHA.9.541.7 and CHA.9.541.8

In one embodiment, CPA.9.086 is combined with an anti-PVRIG antibody as outlined WO2017/041004, including, but not limited to, those having a) a HC sequence SEQ ID NO:5 and LC sequence SEQ ID NO:3 (or the CDR sets contained therein) b) a HC sequence SEQ ID NO:32 and LC sequence SEQ ID NO:33 (or the CDR sets contained therein); and c) a HC sequence SEQ ID NO:32 and LC sequence SEQ ID NO:40 (or the CDR sets contained therein).

In some embodiments, the combination comprises an anti-TIGIT antibody selected from the group consisting of CPA.9.086, CPA.9.083, CHA.9.547.7, and CHA.9.547.13 and the PVRIG antibody is selected from the group consisting of CHA7.518.1 and CHA.7.538.1.2. In some embodiments, the combination comprises an anti-TIGIT antibody selected from the group consisting of CPA.9.086, CPA.9.083, CHA.9.547.7, and CHA.9.547.13 and the PVRIG antibody is CHA7.518.1. In some embodiments, the combination comprises an anti-TIGIT antibody selected from the group consisting of CPA.9.086, CPA.9.083, CHA.9.547.7, and CHA.9.547.13 and the PVRIG antibody is CHA7.538.1.2. In some embodiments, the combination comprises the anti-TIGIT antibody CPA.9.086 and the PVRIG antibody CHA7.518.1. In some embodiments, the combination comprises the anti-TIGIT antibody CPA.9.083 and the PVRIG antibody CHA7.518.1. In some embodiments, the combination comprises the anti-TIGIT antibody CHA.9.547.7 and the PVRIG antibody CHA7.518. In some embodiments, the combination comprises the anti-TIGIT antibody CHA.9.547.13 and the PVRIG antibody CHA7.518.1. In some embodiments, the combination comprises the anti-TIGIT antibody CPA.9.086 and the PVRIG antibody CHA7.538.1.2. In some embodiments, the combination comprises the anti-TIGIT antibody CPA.9.083 and the PVRIG antibody CHA7.538.1.2. In some embodiments, the combination comprises the anti-TIGIT antibody CHA.9.547.7 and the PVRIG antibody CHA7.538.1.2. In some embodiments, the combination comprises the anti-TIGIT antibody CHA.9.547.13 and the PVRIG antibody CHA7.538.1.2.

FIGS. 20-24 provides PVRIG antibodies, as disclosed in U.S. patent application Ser. No. 15/277,978, filed Sep. 27, 2016. The TIGIT antibodies of the present invention can be used in combination with the PVRIG antibodies as disclosed in these figures, as well as those disclosed throughout this application.

5. Assessment of Treatment

Generally, the antibodies of the invention, alone or in combination (PVRIG with PD-1, TIGIT with PD-1 or TIGIT with PVRIG) are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. For example, evaluation of changes in immune status (e.g. presence of ICOS+ CD4+ T cells following ipi treatment) along with "old fashioned" measurements such as tumor burden, size, invasiveness, LN involvement, metastasis, etc. can be done. Thus, any or all of the following can be evaluated: the inhibitory effects of PVRIG or TIGIT on CD4$^+$ T cell activation or proliferation, CD8$^+$ T (CTL) cell activation or proliferation, CD8$^+$ T cell-mediated cytotoxic activity and/or CTL mediated cell depletion, NK cell activity and NK mediated cell depletion, the potentiating effects of PVRIG or TIGIT on Treg cell differentiation and proliferation and Treg- or myeloid derived suppressor cell (MDSC)-mediated immunosuppression or immune tolerance, and/or the effects of PVRIG or TIGIT on proinflammatory cytokine production by immune cells, e.g., IL-2, IFN-γ or TNF-α production by T or other immune cells.

In some embodiments, assessment of treatment is done by evaluating immune cell proliferation, using for example, CFSE dilution method, Ki67 intracellular staining of immune effector cells, and 3H-Thymidine incorporation method.

In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In some embodiments, the assessment of treatment is done by assessing the amount of T cell proliferation in the absence of treatment, for example prior to administration of the antibodies of the invention. If, after administration, the patient has an increase in T cell proliferation, e.g. a subset of the patient's T cells are proliferating, this is an indication that the T cells were activated.

Similarly, assessment of treatment with the antibodies of the invention can be done by measuring the patient's IFNγ levels prior to administration and post-administration to assess efficacy of treatment. This may be done within hours or days.

In general, gene expression assays are done as is known in the art. See for example Goodkind et al., Computers and Chem. Eng. 29(3):589 (2005), Han et al., Bioinform. Biol. Insights Nov. 15, 2015 9(Suppl. 1):29-46, Campo et al., Nod. Pathol. 2013 January; 26 suppl. 1:S97-S110, the gene expression measurement techniques of which are expressly incorporated by reference herein.

In general, protein expression measurements are also similarly done as is known in the art, see for example, Wang et al., Recent Advances in Capillary Electrophoresis-Based Proteomic Techniques for Biomarker Discovery, Methods. Mol. Biol. 2013:984:1-12; Taylor et al, BioMed Res. Volume 2014, Article ID 361590, 8 pages, Becerk et al., Mutat. Res 2011 Jun. 17:722(2): 171-182, the measurement techniques of which are expressly incorporated herein by reference.

In some embodiments, assessment of treatment is done by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, $^{51}$Cr or $^{35}$S release method, LDH activity, MTT and/or WST assays, Calcein-AM assay, Luminescent based assay, and others.

In some embodiments, assessment of treatment is done by assessing T cell activity measured by cytokine production, measure either intracellularly in culture supernatant using cytokines including, but not limited to, IFNγ, TNFα, GM-CSF, IL2, IL6, IL4, IL5, IL10, IL13 using well known techniques.

Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells (Tregs).

Assays to Measure Efficacy

In some embodiments, T cell activation is assessed using a Mixed Lymphocyte Reaction (MLR) assay as is described in the Examples. An increase in activity indicates immunostimulatory activity. Appropriate increases in activity are outlined below.

In one embodiment, the signaling pathway assay measures increases or decreases in immune response as measured for an example by phosphorylation or de-phosphorylation of different factors, or by measuring other post translational modifications. An increase in activity indicates immunostimulatory activity. Appropriate increases in activity are outlined below.

In one embodiment, the signaling pathway assay measures increases or decreases in activation of αβ and/or γδ T cells as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in cytotoxic T cell activity as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in NK and/or NKT cell activity as measured for an example by direct killing of target cells like for an example cancer cells or by cytokine secretion or by changes in expression of activation markers like for an example CD107a, etc. An increase in activity indicates immunostimulatory activity. Appropriate increases in activity are outlined below.

In one embodiment, the signaling pathway assay measures increases or decreases in $\alpha\beta$ and/or $\gamma\delta$ T-cell suppression, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in pro-inflammatory cytokine secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in IL-2 secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in interferon-$\gamma$ production as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in Th1 response as measured for an example by cytokine secretion or by changes in expression of activation markers. An increase in activity indicates immunostimulatory activity. Appropriate increases in activity are outlined below.

In one embodiment, the signaling pathway assay measures increases or decreases in Th2 response as measured for an example by cytokine secretion or by changes in expression of activation markers. An increase in activity indicates immunostimulatory activity. Appropriate increases in activity are outlined below.

In one embodiment, the signaling pathway assay measures increases or decreases cell number and/or activity of at least one of regulatory T cells (Tregs), as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophages cell numbers, as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophage pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in N2 neutrophils increase, as measured for example by flow cytometry or by IHC. A decrease in response indicates immunostimulatory activity. Appropriate decreases are the same as for increases, outlined below.

In one embodiment, the signaling pathway assay measures increases or decreases in N2 neutrophils pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in inhibition of T cell activation, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in inhibition of CTL activation as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in $\alpha\beta$ and/or $\gamma\delta$ T cell exhaustion as measured for an example by changes in expression of activation markers. A decrease in response indicates immunostimulatory activity. Appropriate decreases are the same as for increases, outlined below.

In one embodiment, the signaling pathway assay measures increases or decreases $\alpha\beta$ and/or $\gamma\delta$ T cell response as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in stimulation of antigen-specific memory responses as measured for an example by cytokine secretion or by proliferation or by changes in expression of activation markers like for an example CD45RA, CCR7 etc. An increase in activity indicates immunostimulatory activity. Appropriate increases in activity are outlined below.

In one embodiment, the signaling pathway assay measures increases or decreases in apoptosis or lysis of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases in stimulation of cytotoxic or cytostatic effect on cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases direct killing of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases Th17 activity as measured for an example by cytokine secretion or by proliferation or by changes in expression of activation markers. An increase in activity indicates immunostimulatory activity. Appropriate increases in activity are outlined below.

In one embodiment, the signaling pathway assay measures increases or decreases in induction of complement dependent cytotoxicity and/or antibody dependent cell-mediated cytotoxicity, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, T cell activation is measured for an example by direct killing of target cells like for an example cancer cells or by cytokine secretion or by proliferation or by changes in expression of activation markers like for an example CD137, CD107a, PD1, etc. For T-cells, increases in proliferation, cell surface markers of activation (e.g. CD25, CD69, CD137, PD1), cytotoxicity (ability to kill target cells), and cytokine production (e.g. IL-2, IL-4, IL-6, IFNγ, TNF-a, IL-10, IL-17A) would be indicative of immune modulation that would be consistent with enhanced killing of cancer cells.

In one embodiment, NK cell activation is measured for example by direct killing of target cells like for an example cancer cells or by cytokine secretion or by changes in expression of activation markers like for an example CD107a, etc. For NK cells, increases in proliferation, cytotoxicity (ability to kill target cells and increases CD107a, granzyme, and perforin expression), cytokine production (e.g. IFNγ and TNF), and cell surface receptor expression (e.g. CD25) would be indicative of immune modulation that would be consistent with enhanced killing of cancer cells.

In one embodiment, γδ T cell activation is measured for example by cytokine secretion or by proliferation or by changes in expression of activation markers.

In one embodiment, Th1 cell activation is measured for example by cytokine secretion or by changes in expression of activation markers.

Appropriate increases in activity or response (or decreases, as appropriate as outlined above), are increases of at least about 5%, 10%, 20%, 30%, 40%, 50%, 60%, 70%, 80%, 90%, 95% or 98 to 99% percent over the signal in either a reference sample or in control samples, for example test samples that do not contain an anti-PVRIG antibody of the invention. Specific increases in activity are depicted in FIGS. 27 to 34. For example, with regard to increases in T cell proliferation, CHA.7.518.1.H4(S241P) shows an increase of about 60% and CHA.7.538.1.2.H4(S241P) shows an increase of 47%; relevant increases are shown in either T cell proliferation or IFN-γ of from about 10 to 70% with from about 20 to 60% also finding use.

Similarly, increases of at least one-, two-, three-, four- or five-fold as compared to reference or control samples show efficacy.

XII. EXAMPLES

Reference is made to PCT/US2016/18809, filed Feb. 19, 2016, entitled "PVRIG ANTIBODIES AND METHODS OF TREATMENT", expressly incorporated herein by reference in its entirety, and in particular for the incorporation of Examples 1-5, 7-8, 11-13, 16-20 and 26-28, and the accompanying figures.

A. Example 1: Surface Plasmon Resonance Studies of PVR, PVRL2, and PVRL3 Binding to PVRIG, DNAM, and TIGIT Materials and Methods All experiments were performed using a ProteOn XPR 36 instrument at 22° C.

Step 1: A high density goat anti-human fc polyclonal antibody surface (Invitrogen H10500) was prepared over all six lanes of a GLC chip using a ProteOn XPR 36 biosensor. The activation step for the anti-human fc surface occurred in the horizontal flow direction while the immobilization step for the high density pAb occurred in the vertical flow direction. The blocking step occurred in both the vertical and horizontal positions so that the horizontal "interspots" could be used as reference surfaces. An average of ~4400 RU of goat anti-human pAb was immobilized on each lane.

Step 2: For each cycle, three different lots of human PVRIG fusion protein (human fc, GenScript lots 451, 448, 125), human DNAM-1 fusion protein (human fc, R&D Systems), human TIGIT fusion protein (human fc, R&D Systems), and a control human IgG (Synagis) were each captured over a different vertical lane for two minutes at a concentration of 2 μg/mL. PVR, two lots of PVRL2, and PVRL3 were each injected in the horizontal flow direction at six different concentrations over all six captured ligands at different ligand capture cycles. The injections were two minutes followed by 10 minutes of dissociation at a flow rate of 50 μL/min. The PVR concentration range was 1.4 nM-332 nM in a 3-fold dilution series, both lots of PVRL2 were injected at a concentration range of 1.3 nM-322 nM in a 3-fold dilution series, and PVRL3 was injected at a concentration range of 1.4 nM-334 nM in a 3-fold dilution series. All protein reagents were prepared in running buffer which was degassed PBS buffer with 0.05% Tween 20 and 0.01% BSA added. The anti-human fc capture surfaces were regenerated with two 30-second pulses of 146 mM phosphoric acid after each cycle.

Step 3: Sensorgram data of the analytes binding to each captured ligand were processed and double-referenced using ProteOn Manager version 3.1.0.6 making use of interspot referencing and a pre-blank injection identical to the analyte injections.

Results a) PVR: Binds weakly to captured DNAM-1 and TIGIT and shows no binding to all three lots of PVRIG and the control IgG. Not enough information was generated to estimate the KD of the PVR interactions with DNAM-1 and TIGIT (data not shown).

b) PVRL2: Both lots of PVRL2 showed binding to all three lots of PVRIG and to DNAM-1 but minimal or no binding to TIGIT and no binding to the control IgG. Sensorgrams showed complex kinetics, therefore binding constants could not be estimated (data not shown).

c) PVRL3: Showed minimal binding to TIGIT and did not bind the other proteins (data not shown).

B. Example 2: Effect of PVRIG Knock Down (KD) and Anti-PVRIG Antibody on Human Melanoma Specific TILs Function The aim of these assays is to evaluate the functional capacity of PVRIG in human derived TILs, as measured by activation markers and cytokine secretion, upon co-culture with melanoma target cells.

1. Example 2(1)

The effect of anti-PVRIG antibody (CPA.7.021), which has been shown to block the interaction of PVRIG and PVRL2, alone or in combination with other antibodies (e.g. anti-TIGIT, Anti-DNAM1) was evaluated. PD1 was used as a benchmark immune-checkpoint for the knock down (siRNA) studies.

Materials and Methods: TILs: Tumor-infiltrating lymphocytes (TILs) from three melanoma patients were used (1) TIL-412-HLA-A2-Mart1 specific, (2) TIL-F4-HLA-A2-gp100 specific, and (3) TIL-209-HLA-A2-gp100 specific. TILs were thawed in IMDM (BI, 01-058-1A) full medium supplemented with 10% human serum (Sigma, H3667)+1% Glutamax (Life technologies, 35050-038)+1% Na-Pyruvate (Biological Industries, 03-042-1B)+1% non-essential amino acids (Biological Industries, 01-340-1B)+1% Pen-Strep (Biological Industries, 03-031-1B)+300 U/ml of rhIL2 (Biolegend, 509129).

Tumor cell lines: Human melanoma cells Mel-624 express MART-1 and gp-100 antigens in the context of MHC-I haplotype HLA-A2. Cells were cultured in complete DMEM medium supplemented with 10%, 25 mM HEPES buffer, 1%, and 1% Pen-Strep.

Knock down in TILs: Knock-down (KD) of human PVRIG and human PD1 in TILs was done using 100 pmol of Dharmacon ON-TARGETplus human PVRIG siRNA—SMARTpool (L-032703-02) or Human PD1 siRNA—SMARTpool (L-004435) or non-targeting siRNA (D-001810-01-05). siRNA were electroporated to TILs (AMAXA, program X-005). Electroporation was done on resting TILs cultured in full IMDM supplemented with IL-2 24 hr post thawing. After the electroporation TILs were seeded in 96 well TC plate to recover for 24 hr. After 24 hr, cells were harvested and stained with viability dye (BD Horizon; Cat #562247, BD biosciences), washed with PBS and stained with anti-human PVRIG—CPA.7.021 (CPA.7.021 IgG2 A647, 7.5 ug/ml) or with anti-human PD-1 (Biolegend, #329910 AF647, 5 ug/ml) in room temperature for 30 min. isotype control used are synagis (IgG2 A647, 7.5 ug/ml) and mouse IgG1 (Biolegend #400130 A647, 5 ug/ml) respectively. All samples were run on a MACSQuant analyzer (Miltenyi) and data was analyzed using FlowJo software (v10.0.8).

Co-culture of TILs with 624 melanoma cells: siRNA electroporated TILs were harvested and seeded in 96 TC plate 5×10$^4$/well. Mel-624 cells were harvested as well and seeded in 1:1/1:3 E:T ratios in co-culture. The plate was incubated overnight (18 hr) in 37° C., 5% CO2.

To assess the effect of anti-PVRIG antibody (CPA.7.021), anti-TIGIT (Clone 10A7; from Genentech US Patent Application No. US 2009/0258013) and anti-DNAM1 (clone DX11, first described in Shibuya et al Immunity Volume 4, Issue 6, 1 Jun. 1996, Pages 573-581; BD Biosciences; Mouse anti-human DNAM-1 Clone DX11, Cat No. 559787) on melanoma specific TIL activity, TILs (1×10$^5$ cells/well) were pre-incubated with tested antibodies or relevant isotype controls in mono-treatment (10 μg/mL) or in combination-treatment (final 10 μg/mL for each) prior to the addition of 624 Melanoma target cells at a 1:1 Effector:Target ratio. The plate was incubated overnight (18 hr) in 37° C., 5% CO2.

Assessment of TILs activation: 16 hours post co-culture, cells were stained with viability dye (BD Horizon; Cat #562247, BD biosciences), washed with PBS and exposed to Fc blocking solution (cat #309804, Biolegend), followed by surface staining with anti-CD8a (Cat #301048, Biolegend) and anti-CD137 (Cat #309804, Biolegend) in 4° C. for 30 min. All samples were run on a MACSQuant analyzer (Miltenyi) and data was analyzed using FlowJo software (v10.0.8). Culture supernatants were collected and analyzed for cytokine secretion by CBA kit (Cat #560484, BD).

Results

PVRIG Knock-Down in TILs:

TIL MART-1 and TIL F4 were cultured 24 hr with IL-2. 100 pmol of ON-TARGETplus human PVRIG siRNA—SMART pool (L-032703-02) or Human PD1 siRNA—SMARTpool (L-004435) or non-targeting siRNA (D-001810-01-05) were electroporated to TILs (AMAXA, program X-005). Detection of PVRIG or PD-1 was performed 24 hr post electroporation (and prior to co-culture). Cells were stained for viability dye followed by 30 min RT incubation with anti PVRIG or anti PD-1. The percentage of KD population is indicated in FIG. 82 of U.S. Ser. No. 15/048,967, incorporated by reference herein.

Functional assay using knocked down TILs: Human TILs, cultured for 24 hours with IL2 were electroporated with siRNA encoding for human PVRIG or PD-1 or scrambled sequence as control. TILs were tested for PVRIG and PD-1 expression 24 hr post electroporation. ~80% knock down of PVRIG and ~50% knock down of PD-1 compared to scrambled-electroporated TILs was observed as demonstrated in FIG. 82 of U.S. Ser. No. 15/048,967, incorporated by reference herein.

KD TILs were cultured with Mel-624 cells in 1:1 or 1:3 E:T for 18 hr and were stained for the expression of CD137. Elevated levels of activation marker CD137 were shown in TIL MART-1 electroporated with PVRIG siRNA, similarly to TILs that were electroporated with PD-1 siRNA, compared to control scrambled siRNA (as demonstrated in FIG. 83A of U.S. Ser. No. 15/048,967, incorporated by reference herein). Co-culture supernatant was collected and tested for the presence of secreted cytokines. TILs that were electroporated with PVRIG siRNA show a significant increase in IFNγ and TNF levels compared to control SCR siRNA. A similar effect was shown in TILs that were electroporated with PD-1 siRNA (as demonstrated in FIG. 83B-C of U.S. Ser. No. 15/048,967, incorporated by reference herein).

Figure 84B:
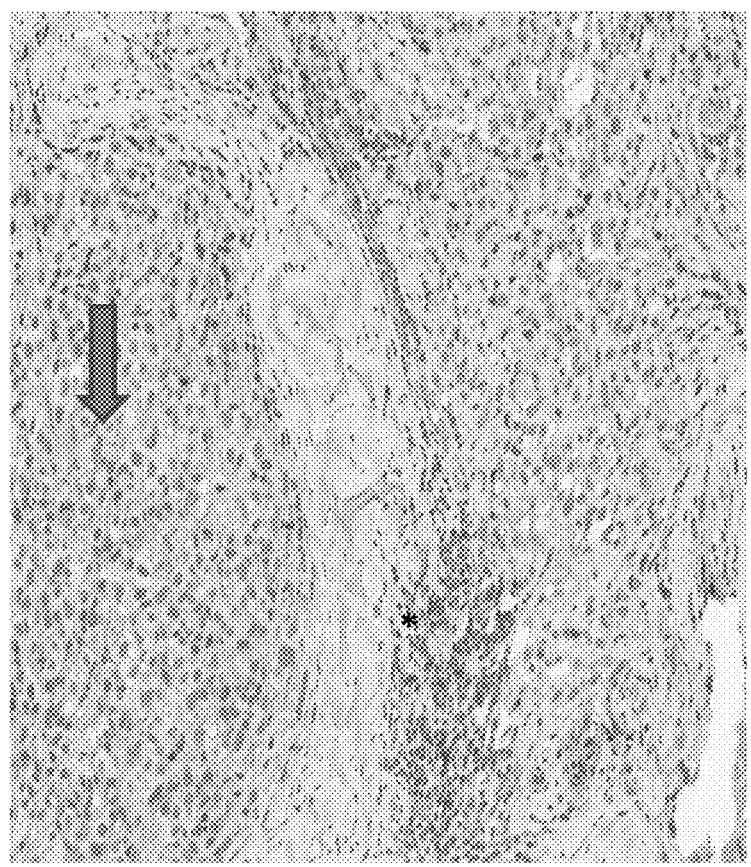

The same trend of increase in activation levels was observed in TIL F4. Co-culture of PVRIG siRNA electroporated TIL F4 with Mel-624 in 1:3 E:T led to increased levels of CD137 surface expression as well as increased secretion of IFNγ in co-culture supernatant as shown in FIGS. 84A and 84B of U.S. Ser. No. 15/048,967, incorporated by reference herein. Similar trends were observed in TILs that were electroporated with PD-1 siRNA.

Functional Assay using Blocking Abs:

In vitro monotherapy and combo therapy of anti-PVRIG and anti-TIGIT: 209 TILs were cultured with Mel-624 cells in 1:1 E:T for 18 hr. Co-culture supernatant was collected and tested for the presence of secreted cytokines. Treatment with anti TIGIT did not affect IFNγ or TNF secretion levels.

However, an increase in IFNγ and TNF levels was observed when anti TIGIT and anti PVRIG were added to co-culture in combination (FIG. 8A-B).

In vitro monotherapy and combo therapy of anti-PVRIG and anti-TIGIT: 209 TILs were cultured with Mel-624 cells in 1:1 E:T for 18 hr. TILs were stained for surface expression of activation marker CD137 and showed reduced level of expression upon treatment with anti DNAM-1. Co-culture supernatant was collected and tested for presence of secreted cytokines. Treatment of anti DNAM-1 mediated a trend to increase secreted cytokines IFNγ and TNF. Treatment with anti DNAM-1 and anti PVRIG in combination partially reversed the effect on CD137 expression (FIG. 9C) and enhanced the effect on cytokine secretion IFNγ and TNF (FIG. 9A-B). MART-1 TILs were cultured with Mel-624 cells in 1:1 E:T for 18 hr. Co-culture supernatant was collected and tested for the presence of secreted cytokines. Treatment with anti DNAM-1 reduced CD137 surface expression on TILs and also the secreted cytokines IFNγ and TNF. Treatment with anti DNAM-1 and anti PVRIG in combination partially reversed these effects (FIG. 9D-F).

Summary and conclusions: PD1 KD improved TIL activity, as measured by IFNγ and secretion in F4 and MART-1 TILs. An increase (~20%) of IFNγ and TNF secretion was observed upon PVRIG KD in MART-1 TILs compared to control siRNA. The same trend was observed in CD137 expression upon co-culture with 624 Melanoma cells on F4 TILs.

Treatment of anti-TIGIT did not affect IFNγ or TNF secretion levels from TILs co-cultured with 624 Mels, however, an increase in IFNγ and TNF levels was observed when anti TIGIT and anti PVRIG (CPA.7.021) were added to co-culture in combination.

Anti DNAM-1 treatment reduced TIL-MART-1 activation manifested by reduced CD137 and cytokine secretion and anti-PVRIG (CPA.7.021) could partially reverse this effect in combo treatment with DNAM-1 Ab. In TIL 209, IFNγ and TNF secretion levels were slightly elevated (~10%) with anti DNAM-1, and an increase in IFNγ and TNF levels (~40% and 30%, respectively) was observed when anti DNAM1 and anti PVRIG (CPA.7.021) were added to co-culture in combination. Collectively, our results showed that PVRIG is a new co-inhibitory receptor for PVRL2.

2. Example 2(2)

The effect of additional anti-PVRIG antibodies (CHA.7.518.1.H4(S241P); CHA.7.524; CHA.7.530; CHA.7.538), which have been shown block the interaction of PVRIG and PVRL2, alone or in combination with other antibodies (e.g. anti-TIGIT, PD1) on TIL-209, TIL-412 and TIL-463-F4 activity upon co-culture with 624 melanoma cell line was evaluated.

Functional antibodies used in this assay were anti hPVRIG hybridoma Abs (mIgG1 backbone)—CHA.7.518.1.H4(S241P); CHA.7.524; CHA.7.530; CHA.7.538 (M1 lot #30816); anti hTIGIT (mIgG1 backbone)—clone 10A7 (Genescript), anti-TIGIT clone MBSA43 (e-biosciences) and mIgG1 (cat #400166, MOPC-21 clone, Biolegend)

Co-culture of TIL and 624 mels: TILs were thawed and cultivated as described in 2.1 24 hr prior to co-culture. Abs tested were added in mono-treatment (10 ug/mL) or in combination with anti TIGIT (20 ug/mL) to seeded TILs and incubated (in total 100 uL) for 1 hr in 37° C., 5% CO2. Mel-624 cells were harvested and seeded in 1:3 Effector: Target ratio in co-culture with TILs. Plate was incubated overnight (18 hr) in 37° C., 5% CO2.

Assessment of TILs functional capacity: T cell activity was assessed based on detection of IFNγ in co-culture supernatants. Culture supernatants were collected and tested for cytokines by CBA kit (Cat #560484, BD) or by MAG-PIX human IFNγ/TNFα kit. Two tailed unpaired T-tests were calculated. P<0.05 was referred to as statistically significant.

Results

Functional Assay Using TILs and Melanoma Cells in the Presence of Anti PVRIG Hybridoma Abs:

Human TILs, cultured for 24 hours with IL2 were co-cultured with Mel-624 cells in 1:3 E:T for 18 hr and tested for cytokine secretion. FIG. 31 described a representative experiment out of 5-6 performed. TILs were co-cultured with melanoma cells 624 in the presence of anti-TIGIT or anti-PVRIG Abs (blue) or in combination of anti-TIGIT and anti PVRIG (green) and tested for IFNγ/TNF secretion. In this experiment, all 4 anti-PVRIG Abs mono treatments increased (20-30%) IFNγ secretion in 2 out of 3 TILs tested (TIL-209 and TIL463-F4) while in combination with anti-TIGIT all anti-PVRIG Abs CHA.7.518.1.H4(S241P), CHA.7.530, CHA.7.538 increased IFNγ secretion compared to anti-TIGIT treatment alone.

The effect of Ab CHA.7.518.1.H4(S241P) was found statistically significant across experiments in TIL 463-F4-gp100 across 5 experiments as mono and in combination with anti-TIGIT (FIG. 9E, G). Combo treatment of anti-PVRIG Ab CHA.7.518.1.H4(S241P) effect was also statistically significant in TIL 209 (FIG. 9C). Combo treatment effect of anti PVRIG Ab CHA.7.538 was found statistically significant in TIL 463-F4-gp100 (FIG. 9F).

Summary and Conclusions:

In the experimental systems described herein we observed an effect of anti PVRIG on TILs in response to target melanoma cells as seen by changes in IFNγ secretion. Anti PVRIG Hybridoma Abs tested mediated an increase in IFNγ secretion compared to relevant isotype control. Ab CHA.7.518.1.H4(S241P) seems to have an advantage in mediating an increase in IFNγ secretion as a mono-treatment and compared to other aPVRIG Abs tested however the magnitude of this effects varies between different TILs. This effect is enhanced in combination with anti-TIGIT treatment.

3. Example 2(3)

The aim is to evaluate the functional activity of anti-human PVRIG antibodies (CHA.7.518.1.H4(S241P); CHA.7.544; or CHA.7.538) on human TILs activity upon co-culture with peptide-pulsed CHO-S cells stably co-expressing HLA-A2, b2 microglobulin (B2M) and PVRL2.

TILs from resected metastases of three melanoma patients were used: TIL-412-HLA-A2-Mart1(26-35) specific, TIL-463-F4-HLA-A2-gp100(209-217) specific, TIL-463-F5-HLA-A2-gp100(209-217) specific, and TIL-209-HLA-A2-gp100(209-217) specific.

TILs were thawed in IMDM full medium supplemented with 10% human serum+1% Glutamax+1% Na-Pyruvate+1% non-essential amino acids+1% Pen-Strep+300 U/ml of rhIL2 (Biolegend, 589106).

CHO-S cells (target cells) were stably transduced with a lentivirus expressing HLA-A2/B2M (lentivirus vector cat #CD515B-1-SBI, system biosciences) and grown under 600 ug/ml of hygromycin B selection in CD CHO medium (Cat #10743-011) supplemented with 8 mM GlutaMax 1% and 1% Pen/Strep. HLA-A2/B2M expressing cells were then cloned by limiting dilution. The 3E8 clone with high HLA-A2 and B2M expression was then transduced with a lentivirus expressing human PVRL2 (lentivirus vector cat #CD510B-1-SBI, system biosciences), and grown under 6 ug/ml puromycin selection.

In the experimental system described herein (depicted in FIG. 35), gp100 or MART-1-reactive TILs that endogenously express TIGIT, DNAM-1 and PVRIG FIG. 37) were co-cultured with peptide-pulsed CHO-S HLA-A2/B2M/PVRL2 cells.

Functional antibodies used in this assay were anti human PVRIG; Ab 461 (Aldeveron)—referred to 544 in this example, anti human PVRIG chimera Ab (hIgG4 back bone)—CHA.7.538; CHA.7.518 (referred to c538 and c518 in this example, meaning that the variable heavy and light regions from 7.538 and 7.518 were fused to human IgG4 constant regions anti human TIGIT (mIgG1 backbone) clone MBSA43 (e-biosciences), mIgG1 (biolegend) and hIgG4 (biolegend).

TILs were thawed and cultured as described herein for 24 hr prior to co-culture with target cells. The tested antibodies were added in mono-treatment (10 ug/mL) or in combination with anti TIGIT (total 20 ug/mL) to seeded TILs and incubated (in total 100 uL) for 30 min in 37° C., 5% CO2. CHO-S cells were harvested and pulsed with 0.1 or 0.5 ug/ml of gp-100 (gp100209-217) or with 20 ug/ml of MART-126-35 peptides, for 1 hour at 37° C. in Opti-MEM™ reduced serum media. Following tree washes with Opti-MEM™ reduced serum media, peptide-pulsed target cells were over-night (18 hr) co-cultured with TILs at Effector:Target ratio of 1:3 (33k:100k).

Assessment of TILs functional capacity: The effect of anti PVRIG antibodies (10 ug/ml) as mono treatment or as combo treatment with anti TIGIT on TILs activity was assessed using measurement of cytokines secretion from over-night co-culture supernatants using Combined Bead Array (CBA) kit (Cat #560484, BD). All samples were acquired in MACSQuant analyzer (Miltenyi) and data was analyzed using FlowJo software (v10.0.8).

Dose response of anti PVRIG antibodies: The effect of anti PVRIG antibodies c518, c538 (or hIgG4 isotype control) dose response was tested on the described assay in an antibodies concentration of 30, 10, 3, 1, 0.3, 0.1 and 0.03 ug/ml. Two tailed unpaired T-tests were calculated. $P<0.05$ was referred to as statistically significant.

Results

Effect of anti PVRIG antibodies on TILs activity upon co-culture with CHO-S HLA-A2/B2M cells expressing PVRL2: The effect of three anti PVRIG antibodies (544, c538 and c518) on the activity of four different TILs (412, 463, 462 and 209) from two different experiments is summarized in FIG. 37. Ab served as non-blocker Ab control. The detailed results of the experiments are presented in FIG. 39. Treatment with 544, c538 and c518 antibodies increased the levels of IFN secretion from TILs (on average of 6%, 28% and 23%, respectively) compared to treatment with isotype antibody. Increased IFN secretion was detected in TILs treated with c538 or c518 compared to 544, the non-blocker control. No significant difference was found between treatments with c538 to c518 Abs. Treatment with anti TIGIT increased IFN secretion from TILs (on average of 49%) compared to isotype. The combo treatment of c518 and c538 with anti TIGIT induced additive effect in IFN secretion from TILs, but the combo effect was not statistically significant compare to treatment with mono treatment of TIGIT.

Effect of anti-PVRIG antibodies dose response on TILs functional capacity: The effect of adding anti PVRIG antibodies (c538 and c518) in dose response on the activity of TILs F4 and 209 was evaluated (FIG. 80). The EC50 of c518 and c538 antibodies is in the single digit nM compared to isotype control as measured by the effect of TNFα secretion from the TILs.

Summary and conclusions: In the experimental system described herein we observed effect of anti PVRIG antibodies on TILs activity in response to co-culture with peptide-pulsed CHO-S HLA-A2/B2M target cells over-expressing PVRL2. The anti PVRIG antibodies that were tested mediated an increased secretion of IFN and TNF from TILs compared to the relevant isotype control. Antibodies c518 and c538 have statistical significant advantage (p-0.0063 and p-0.0034 respectively) on TIL activity, as manifested by IFN secretion, as compared to 544, which is a non-blocker antibody of PVRIG (based on competition experiment clone on PVRIG expressing cells). Both c518 and c538 antibodies had an additive effect with anti TIGIT antibody (no statistical significant).

4. Example 2(4)

The aim of this example was to evaluate the functional capacity of PVRIG in human derived TILs as measured by cytokine secretion upon co-culture with melanoma target cells. The effect of anti-PVRIG antibodies (CHA.7.518.1.H4 (S241P); CHA.7.524; CHA.7.530; CHA.7.538), which have been shown block the interaction of PVRIG and PVRL2, alone or in combination with other antibodies (e.g. anti-TIGIT, PD1) was evaluated.

Purified CD3+ T cells were obtained using Rossetesep human T cell enrichment cocktail kit (Stem cell technologies) on buffy coat blood samples. Cells were thawed and labeled with CFSE (Moleculare probes) to be able to track proliferation in co-culture.

CHO-S-OKT3 cells: CHO-S cells were transduced with CD5L-OKT3-scFv-CD14 in CD710B-1 (SBI, cat #CS965A-1, lot #151014-005, 1.40×108 ifus/ml). Cells were cultured in the presence of CD CHO (Gibco, life technologies Cat #10743-011) with addition of 8 mM GlutaMax and 6 µg/ml puromycin. Surface OKT3 levels were evaluated by flow cytometry using PE-goat anti-mouse IgG F(ab)'2 at 1:200 dilution (Jackson Immunoresearch, cat #115-116-146). CHO-S-OKT3 cells were then transiently transfected with human PVRL2 (delta isoform) or empty vector using Amaxa electroporation system (Lonza, Walkersville, Md., USA) according to the manufacturer's instructions. 5 ug of pcDNA3.1 plasmid (empty vector or hPVRL2) per 2×106 cells in Ingenio™ Electroporation Solution (Minus, Cat #MC-MIR-50115) and pulse-program U-024 were used. Expression of PVRL2 on transfected CHOS-S-OKT3 cells was evaluated by flow cytometry using anti-PVRL2 Ab (cat #337412, Biolegend).

The functional antibodies used in this assay were Anti hPVRIG hybridoma Abs (mIgG1 backbone)— CHA.7.518.1.H4(S241P); CHA.7.524; CHA.7.530; CHA.7.538, anti-TIGIT clone MBSA43 (e-biosciences) and mIgG1 (cat #400166, MOPC-21 clone, Biolegend).

Co-culture of CD3 T cells and CHO-OKT3 cells: CD3+ T cells were thawed and immediately labeled with CFSE. In parallel CHO-S-OKT3-PVRL2 cells were harvested and treated with Mitomycin-C for 1 hr in 37° C., washed and added to co-culture with T cells in 1:5 E:T (1×105 T cells and 2×104 CHO-OKT3-PVRL2 or mock). Abs were added in mono-treatment (10 ug/mL) or in combination with anti TIGIT (10 ug/mL) and co-culture plates were incubated 37° C., 5% CO2 for 5 days. After 5 days cells were harvested and T cell proliferation wad analyzed by FACS gating on CD4 and CD8 sub-populations.

Effect of anti-PVRIG antibodies in CHOS-OKT3 co-culture assay: CFSE-labeled T cells were stimulated with stimulator cells (CHO cells expressing membrane-bound anti-CD3 mAb fragments). CHOS-stimulator cells expressing human PVRL2 and control stimulator cells (empty vector) treated with mitomycin C (50 ug/ml for 1 h) before co-cultured with CFSE-labeled human T cells at the ratio of 1:5. After 5 days at 37° C. and 5.0% CO2, the effect of anti-PVRIG antibodies (10 ug/ml) on T cell proliferation (CFSE dilution) and cytokine secretion (ELISA or TH1/2/17 CBA kits) in culture supernatants was assessed. All samples were acquired in MACSQuant analyzer (Miltenyi) and data was analyzed using FlowJo software (v10.0.8). Culture supernatants were collected and analyzed for cytokine secretion by CBA kit (Cat #560484, BD).

Results

Effect of anti-PVRIG antibodies on PVRL2 over-expression in CHOS-OKT3 assay: CHOS-OKT3 overexpressing PVRL2 or mock (empty vector) cells were co-cultured with CD3+ cells and the effect of anti-PVRIG antibodies as mono treatment or in combination with anti-TIGIT on T cell proliferation and cytokine secretion was tested (FIG. 40). After 5 days cells were harvested and analyzed for CFSE dilution. In parallel co-culture supernatant was collected and tested for cytokine secretion. FIG. 41 shows the effect of anti-PVRIG Abs in responder vs. non responder donor. The effect of various anti-PVRIG Abs on T cell proliferation as mono treatment in combination with anti-TIGIT were evaluated. While some anti-PVRIG Ab enhance T cell proliferation, no additive effect with anti-TIGIT antibody was observed in this system (FIG. 42). These effects were not seen when the Abs were tested in co-culture of CD3+ cells with mock (empty vector transfected) CHO-S cells (data not shown).

Total of 10 donors were tested and 5 out of 10 donors responded to anti-PVRIG Abs. Treatment of Ab CHA.7.518.1.H4(S241P) consistently resulted in enhanced IFNγ secretion ranging between 20-50% across 5 responder donors tested while treatment with other Abs did not demonstrate a clear trend (FIG. 43). Similar effects were observed in CD8+ cells proliferation. Effect of Abs treatment are summarized in FIG. 44.

C. Example 3: Effect of Anti-PVRIG Antibody on Human Melanoma Specific TILs Function in Combination with Anti-TIGIT and Anti-PD1 Antibodies

1. Example 3(1)

Materials and Methods

TILs: Tumor-infiltrating lymphocytes (TILs) from three melanoma patients were used: (1) TIL-412-HLA-A2-Mart1 specific, (2) TIL-F4-HLA-A2-gp100 specific and (3) TIL-209-HLA-A2-gp100 specific.

TILs were thawed in IMDM (BI, 01-058-1A) full medium supplemented with 10% human serum (Sigma, H3667)+1% Glutamax (Life technologies, 35050-038)+1% Na-Pyruvate (Biological Industries, 03-042-1B)+1% non-essential amino acids (Biological Industries, 01-340-1B)+1% Pen-Strep (Biological Industries, 03-031-1B)+300 U/ml of rhIL2 (Biolegend, 509129).

Tumor cell lines: Human melanoma cells Mel-624 express MART-1 and gp-100 antigens in the context of MHC-I haplotype HLA-A2. Cells were cultured in complete DMEM medium (Biological Industries, 01-055-1A) supplemented with 10% FBS (BI, 04-127-1A), 25 mM HEPES buffer (BI, 03-025-1B), 1% Glutamax (Life technologies, 35050-038), and 1% Pen-Strep (Biological Industries, 03-031-1B).

Co-culture of TILs with 624 melanoma cells in the presence of anti-PVRIG, anti-TIGIT and PD1 blocking antibodies: To assess the effect of anti-PVRIG antibody (CPA.7.021), anti-TIGIT (Clone 10A7) and anti-PD1 (mAb 1B8, Merck) on melanoma specific TIL activity, TILs (3×104 cells/well) were pre-incubated with tested antibodies or relevant isotype controls in mono-treatment (10 μg/mL) or in combination-treatment (final 10 μg/mL for each) prior to addition of 624 Melanoma target cells at 1:3 Effector: target ratio. Plate was incubated overnight (18 hr) in 37° C., 5% CO2.

Assessment of TILs activation: Culture supernatants were collected and analyzed for cytokine secretion by CBA kit (Cat #560484, BD).

In vitro monotherapy anti-PVRIG and combo-therapy of with anti-TIGIT and PD1 blocking antibodies: F4 TILs (gp100 specific) were cultured with Mel-624 cells in 1:3 E:T for 18 hr. Co-culture supernatant was collected and tested for presence of secreted cytokines. Treatment of anti-TIGIT or anti-PD1 did not affect IFNγ or TNF secretion levels. However, an increase in IFNγ and TNF levels was observed when anti TIGIT or anti-PD1 in combination with anti PVRIG were added to co-culture in combination (FIG. 10A-B).

Treatment of anti-PVRIG, anti-TIGIT and PD1 alone did not affect IFNγ or TNF secretion levels from TILs co-culture with 624 Mels, however, an increase in IFNγ and TNF levels was observed when anti-TIGIT or anti-PD1 antibodies were added in combination with anti PVRIG (CPA.7.021). The presented data suggest that there is synergistic effect for combinatory therapy with anti-TIGIT or anti-PD1 antibodies.

2. Example 3(2)

Again, the ability of anti-PVRIG antibodies to enhance CD4+ and CD8+ T cell function in combination with an anti-TIGIT antibody in a primary in vitro cell-based assay was assessed.

CHO-S OKT3 assay: The CHO-S OKT3 assay was utilized to determine whether the combination of a humanized PVRIG antibody, CHA.7.518.1.H4(S241P), and a commercially available anti-TIGIT antibody could increase T cell proliferation, and cytokine secretion greater than a single anti-PVRIG or anti-TIGIT antibody treatment. The target cells used in the co-culture assay were the Chinese hamster ovary cell line, CHO-S (ATCC), stably overexpressing the single chain variable fragment of the anti-human CD3 antibody Clone OKT3 (abbreviated as OKT3), and human PVRL2 (abbreviated as hPVRL2). CHO-S OKT3 parental cells were grown in serum-free CD-CHO medium supplemented with 40 mM glutamax, penicillin/streptomycin, and 6 μg/ml puromycin. CHO-S OKT3 hPVRL2 cells were grown in serum-free CD-CHO medium supplemented with 40 mM glutamax, penicillin/streptomycin, 6 μg/ml puromycin, and 600 μg/ml hygromycin B.

Primary CD3+ and CD8+ T cells were isolated from healthy human donors using the RosetteSep™ human CD3+ T cell enrichment cocktail (Stemcell Technologies), and the human CD8+ microbeads (Miltenyi Biotec), respectively, and frozen in liquid nitrogen. On the day of the co-culture assay, CD3+ or CD8+ T cells were thawed, counted, and labeled with 1 μM CFSE (Life Technologies) for 10 minutes at 37° C. Following this incubation, T cells were washed and resuspended in complete medium containing RPMI, supplemented with 10% heat-inactivated FBS, glutamax, penicillin/streptomycin, non-essential amino acids, sodium pyruvate, and 50 μM @-mercaptoethanol. CHO-S OKT3 hPVRL2 cells were harvested from culture, and treated with mitomycin C for 1 hour at 37° C. with periodic mixing. After the incubation, the target cells were thoroughly washed, counted, and resuspended in complete RPMI medium. The assay was set up with a 5:1 ratio of T cells (100,000) to target cells (20,000). The target cells, T cells, and 10 μg/ml of each antibody treatment were added together in a 96-well U-bottom plate (Costar), and incubated for either 3 days (CD8+ T cells), or 5 days (CD4+ T cells) at 37° C. The antibody treatments included human CHA.7.518.1.H4(S241P) IgG4 alone, a human IgG4 isotype control combined with the mouse anti-human TIGIT (Clone MBSA43, eBioscience), and a combination of CHA.7.518.1.H4(S241P) and anti-TIGIT (Clone MBSA43). In addition, the activity of the mouse anti-human DNAM-1 IgG1 (Clone DX11, BioLegend), mouse IgG1 isotype control (Clone MOPC21, BioLegend), and a human IgG4 isotype control was also assessed.

After the 3 or 5-day incubation period, co-culture supernatants were analyzed for secreted cytokines, including IL-2, IL-4, IL-5, IL-6, IL-9, IL-10, IL-13, IL-17A, IL-17F, IL-21, IL-22, TNFα, and IFNγ, with the cytometric bead array (CBA) human Th1/Th2/Th17 cytokine kit (BD Biosciences), or with the LEGENDplex™ Human Th cytokine kit (BioLegend). T cell proliferation was measured by staining CD4+ or CD8+ T cells with the LIVE/DEAD fixable aqua dead cell stain kit (ThermoFisher Scientific), anti-CD4 antibody (Clone RPA-T4, BioLegend), and anti-CD8 antibody (Clone HIT8a, BioLegend), and gating on the percentage of live, CFSE low proliferating CD4+ or CD8+ T cells. Data was acquired using a FACS Canto II (BD Biosciences), and analyzed using FlowJo (Treestar) and Prism (Graphpad) software.

Results: Combination of CHA.7.518.1.H4(S241P) and an anti-TIGIT antibody augments CD4+ T cell proliferation compared to single antibody treatments: The ability of CHA.7.518.1.H4(S241P) humanized hybridoma-derived PVRIG antibody to enhance primary CD4+ T cell proliferation in vitro when combined with an anti-TIGIT antibody was assessed with the CHO-S OKT3 assay.

FIGS. 33A and B show the percentage of proliferating CD4+ T cells from two different donors in response to co-culture with the CHO-S OKT3 hPVRL2 target cells, and treated with anti-PVRIG and anti-TIGIT antibodies either alone or in combination. In these two representative human CD3+ T cell donors, the combination of CHA.7.518.1.H4 (S241P) and the anti-TIGIT antibody increases CD4+ T cell proliferation compared to CHA.7.518.1.H4(S241P) alone, or the combination of IgG4 isotype and the anti-TIGIT antibody. The anti-DNAM-1 antibody reduces CD4+ T cell proliferation compared to the IgG1 isotype control in both donors.

CHA.7.518.1.H4(S241P) and an anti-TIGIT antibody enhances CD8+ T cell proliferation and IFN-g secretion FIG. 34A illustrates the ability of the humanized PVRIG antibody, CHA.7.518.1.H4(S241P), to increase CD8+ T cell proliferation in combination with the anti-TIGIT antibody in the CHO-S OKT3 assay. In a representative human CD8+ T cell donor, the combination of CHA.7.518.1.H4(S241P) and the anti-TIGIT antibody increases CD8+ T cell proliferation when T cells are co-cultured with the CHO-S OKT3 hPVRL2 cells. The combination of anti-PVRIG and anti-TIGIT antibodies increases proliferation greater than CHA.7.518.1.H4(S241P) alone, or the hIgG4 isotype plus anti-TIGIT antibody treatment. FIG. 34B shows that in the same representative human CD8+ T cell donor as described above, the humanized PVRIG antibody, CHA.7.518.1.H4 (S241P), in combination with the anti-TIGIT antibody also enhances IFNγ secretion in the CHO-S OKT3 assay. The combination of anti-PVRIG and anti-TIGIT antibodies increases IFNγ secretion greater than CHA.7.518.1.H4 (S241P) alone, or the hIgG4 isotype plus anti-TIGIT antibody treatment. The anti-DNAM-1 antibody reduces both CD8+ T cell proliferation and IFNγ production compared to the IgG1 isotype control antibody.

Summary and Conclusions

Together, the humanized PVRIG antibody, CHA.7.518.1.H4(S241P) and the anti-TIGIT antibody had in vitro functional activity in the primary cell-based CHO-S OKT3 assay. The combination of CHA.7.518.1.H4(S241P) and the anti-TIGIT antibody led to increased CD4+ and CD8+ T cell proliferation, as well as IFNγ secretion from CD8+ T cells compared to treatment with either CHA.7.518.1.H4(S241P) or the anti-TIGIT antibody alone. Together, these data demonstrate that co-blockade of the two checkpoint receptors, PVRIG and TIGIT, increased T cell function compared to single receptor blockade.

It should be noted that TIGIT does not interact with CD112 (PVRL2; see FIGS. 4E and 4F of Zhu et. al., J. Exp. Med. (2016):1-10); rather, it interacts with PVR, a different ligand. PVR is expressed in the CHO/CD112 system of Zhu et al. Accordingly, our interpretation of the combination effect of the aCD112R (anti-PVRIG antibody) and anti TIGIT is that the aCD112R/aPVRIG is blocking the interaction of human CD112R with human CD112, but the anti TIGIT antibody is blocking the interaction of human TIGIT with human or hamster PVR (on T cells or CHO cells), Zhu et al do not really give a hypothesis as to why the anti CD112R/anti TIGIT combination effect is occurring in the CHO CD112 assay. That is, the combination effect is not through the PVRL2/CD112 ligand alone.

D. Example 4: Epitope Mapping of Anti-Human PVRIG Antibodies Based on Cynomolgus Cross-Reactivity Rationale and Objectives The objective of this study is to identify the epitopes on the PVRIG protein that determine cross-reactivity of anti-human PVRIG antibodies against the cynomolgus monkey (cyno) orthologue. Many of the antibodies against human PVRIG target show varied degrees of cyno cross-reactivity despite the fact that many of these antibodies belong to the same epitope bin. To shed light on the molecular basis of human/cyno cross-reactivity (or lack thereof), several cyno-to-human mutations of the PVRIG recombinant proteins were designed, expressed and purified, and tested for binding to a panel of anti-human PVRIG antibodies in ELISA.

Methods

Design of Cyno-to-Human PVRIG Variants:

Sequence alignment of human and PVRIG ECDs shows 90% sequence identity and 93% sequence homology between human and cyno orthologs. Based on the nature of the mutations (conserved vs non-conserved) and the secondary structure prediction (coil vs extended) of the mutation region, three site-directed mutants of the cyno PVRIG were designed to probe the cyno-cross reactivity focused epitope mapping. These mutants include H61R, P67S, and L95R/T97I cyno PVRIG. Wild type cyno and human PVRIG were also generated.

Expression and purification of cyno, human, and hybrid PVRIG variants: All the PVRIG variants were expressed as ECD fusions with a C-terminal 6× His tag in mammalian cells. The proteins were purified by affinity purification, ion-exchange chromatography, and size-exclusion chromatography. The purified proteins were buffer-exchanged into PBS buffer (pH 7.4) and stored at 4° C.

ELISA to determine PVRIG-antibody interaction: The functional ELISA was performed as follows: cyno, human, and cyno/human hybrid PVRIG (His-tagged) recombinant proteins were adsorbed on an IA plate overnight at 4° C. Coated plate wells were rinsed twice with PBS and incubated with 300 µL blocking buffer (5% skim milk powder in PBS pH 7.4) at room temperature (RT) for 1 hr. Blocking buffer was removed and plates were rinsed twice more with PBS. Plate-bound PVRIG variants were incubated with anti-human PVRIG mAbs (human IgG1 isotype) in solution (linear range of 0.1 µg/mL to 8 µg/mL in a 50 µL/well volume) at RT for 1 hr. Plates were washed three times with PBS-T (PBS 7.4, 0.05% Tween20), then three times with PBS and 50 µL/well of a HRP-conjugated secondary antibody was added (Human IgG Fc domain specific, Jackson ImmunoResearch). This was incubated at RT for 1 hr and plates were washed again. ELISA signals were developed in all wells by adding 50 µL of Sureblue TMB substrate (KPL Inc) and incubating for 5-20 mins. The HRP reaction was stopped by adding 50 µL 2N H2SO4 (VWR) and absorbance signals at 450 nm were read on a SpectraMax (Molecular Devices) or EnVision (PerkinElmer) spectrophotometer. The data were exported to Excel (Microsoft) and plotted in GraphPad Prism (GraphPad Software, Inc.).

Results

S67, R95, and I97 Residues as Determinants of Cyno Cross-Reactivity:

The binding data shown in FIG. 18 clearly shows that the S67, R95, and I97 residues affect the cyno cross-reactivity of various antibodies. While the P67S cyno-to-human mutation negatively impacts the binding of CPA.7.002 and CPA.7.041, the L95R/T97I cyno-to-human mutation significantly improves the binding of CPA.7.002, CPA.7.021, CPA.7.028, and CPA.7.041. On the other hand, H61R cyno-to-human mutation does not affect the binding of any of the antibodies tested.

Relative binding to cyno-to-human variants suggests three epitope groups: The relative binding of the antibodies to cyno, human and hybrid PVRIG variants suggests 3 distinct epitope groups: Group 1 binds to R95/I97 residues (CPA.7.021 and CPA.7.028). Group 2 binds to S67 and R95/I97 residues (CPA.7.002 and CPA.7.041). Group 3 does not bind to S67 or R95/I97 residues (CPA.7.024 and CPA.7.050). The epitope groups show strong correlation to the degree of cyno cross-reactivity of these antibodies (FIG. 19).

Summary and Conclusions:

The restricted epitope mapping based on cyno-to-human variations in the PVRIG ECD identified S67, R95, and I97 residues as determinants of cyno cross-reactivity of anti-human PVRIG antibodies. The complete restoration of binding to L95R/T97I cyno PVRIG for CPA.7.021 and CPA.7.028 antibodies and improved binding of CPA.7.002 to this mutant strongly suggests that R95 and I97 residues are critical human PVRIG epitopes for these antibodies. These findings also suggest a possible way to predict cross-reactivity to non-human primate PVRIG orthologs based on their primary amino acid sequence.

E. Example 5: Humanized Antibodies: Binding and Receptor-Ligand Blocking Analysis of Humanized Anti-PVRIG Hybridoma-Derived Antibodies, CHA.7.518.1.H4(S241P) and CHA.7.538.1.2.H4(S241P)

This experiment was run to characterize the binding of CHA.7.518.1.H4(S241P) and CHA.7.538.1.2.H4(S241P) to human and cynomolgus PVRIG protein on cell lines and primary leukocytes, to characterize the capacity of CHA.7.518.1.H4(S241P) and CHA.7.538.1.2.H4(S241P) to block the interaction between PVRIG and PVRL2 and to characterize the epitope space of CHA.7.518.1.H4(S241P) and CHA.7.538.1.2.H4(S241P) relative to each other, by assessing competition for binding to PVRIG antigen expressed on Jurkat cells.

FACS analysis of hPVRIG over-expressing cells: The following cell lines were used to assess the specificity of CHA.7.518.1.H4(S241P) and CHA.7.538.1.2.H4(S241P): HEK parental and HEK hPVRIG over-expressing cells. These cells were cultured in DMEM (Gibco)+10% fetal calf serum (Gibco)+glutamax (Gibco). For the HEK hPVRIG over-expressing cells, 0.5 ug/ml puromycin (Gibco) was also added to the media for positive selection. For FACS analysis, all cell lines were harvested in log phase growth and 50,000-100,000 cells per well were seeded in 96 well plates. Binding of unconjugated CHA.7.518.1.H4(S241P) and CHA.7.538.1.2.H4(S241P) (hIgG4) and their respective controls were assessed in an 8-point titration series starting at 10 ug/ml on ice for 30 mins-1 hr. The titration series was conducted as 3 fold serial dilutions. Unconjugated primary antibodies were detected with an anti-human Fc Alexa 647 conjugated antibody (Jackson Laboratories). Data was acquired using a FACS Canto II (BD Biosciences), FACS LSR Fortessa X-20 (BD Biosciences), or IntelliCyt (IntelliCyt Corporation) and analyzed using FlowJo (Treestar) and Prism (Graphpad) software.

FACS analysis of human cell lines for hPVRIG: The following cell lines were used to assess the expression and specificity of CHA.7.518.1.H4(S241P) and CHA.7.538.1.2.H4(S241P): Jurkat and HepG2. Jurkat cells were cultured in RPMI media+10% fetal calf serum, glutamax, non-essential amino acids (Gibco), sodium pyruvate (Gibco), and penicillin/streptomycin (Gibco). HepG2 cells were cultured in DMEM+10% fetal calf serum+glutamax. For FACS analysis, all cell lines were harvested in log phase growth and 50,000-100,000 cells per well were seeded in 96 well plates. Binding of unconjugated CHA.7.518.1.H4 (S241P) and CHA.7.538.1.2.H4(S241P) (hIgG4) and their respective controls were assessed in an 8-point titration series starting at 10 ug/ml on ice for 30 mins-1 hr. Unconjugated primary antibodies were detected with an anti-human Fc Alexa 647 conjugated antibody. The titration series were conducted as 3-fold serial dilutions. Data was acquired using a FACS Canto II or IntelliCyt and analyzed using FlowJo and Prism software.

FACS analysis of PVRIG on CMV-expanded CD8 T cells: CMV reactive donors were purchased from Cellular Technology Limited (CTL). Supplied PBMC were pulsed for 2 hours with 10 uM CMV peptide 494-503 (NLVPMVATV, Anaspec). The PBMC were subsequently washed three times after which they were plated in 24 well plates for 9 days in RPMI+10% human AB serum (Sigma), glutamax, penicillin/streptomycin, and a cytokine growth cocktail consisting of 2 ng/ml IL-2 (R&D systems) and 10 ng/ml IL-7 (R&D systems). After 9 days, non-adherent cells were harvested, phenotyped for CD8 T cell enrichment, and banked in liquid nitrogen.

To assess expression on CMV-expanded CD8 T cells, binding of unconjugated CHA.7.518.1.H4(S241P) and CHA.7.538.1.2.H4(S241P) (hIgG4) and their respective controls was assessed in an 8-point titration series starting at 666 nM on ice for 30 mins-1 hr. The titration series was conducted as a 4-fold serial dilution series. Unconjugated primary antibodies were detected with an anti-human Fc Alexa 647 conjugated antibody. Data was analysed using FlowJo and Prism software and collected on a BD LSR Fortessa X-20.

FACS analysis of cynomolgus PVRIG engineered overexpressing cells: The following cell lines were used to assess the cross-reactivity of CHA.7.518.1.H4(S241P) and CHA.7.538.1.2.H4(S241P) with cynomolgus PVRIG (cPVRIG): expi parental and expi cPVRIG over-expressing cells. These cells were cultured in DMEM+10% fetal calf serum+glutamax. expi cPVRIG transient over-expressing cells were generated by electroporating cPVRIG DNA into parental expi cells using the Neon transfection system. For FACS analysis, expi cPVRIG cells were used between 1-3 days-post transfection. Parental expi cells were harvested from log growth phase. 50,000-100,000 cells of per well of each type were seeded in 96 well plates. Binding of unconjugated CHA.7.518.1.H4(S241P) and CHA.7.538.1.2.H4 (S241P) (hIgG4) and their respective controls were assessed in an 8-point titration series starting at 10 ug/ml on ice for 30 mins-1 hr. The titration series were conducted as a 3-fold dilution series. Unconjugated primary antibodies were detected with an anti-human Fc Alexa 647 conjugated antibody. Data was acquired using a FACS Canto II or IntelliCyte and analyzed using FlowJo and Prism software.

Cellular-based receptor-ligand blocking assays: The ability of CHA.7.518.1.H4(S241P) and CHA.7.538.1.2.H4 (S241P) to inhibit the interaction of PVRIG with its ligand PVRL2 was assessed in a cellular competition assay conducted in two orientations.

In the first orientation, PVRL2 is endogenously expressed on un-manipulated HEK cells, and the ability of CHA.7.518.1.H4(S241P) and CHA.7.538.1.2.H4(S241P) to block soluble biotinylated PVRIG Fc binding to HEK cells was measured. More specifically, biotinylated PVRIG Fc protein (33 nM) and CHA.7.518.1.H4(S241P) and CHA.7.538.1.2.H4(S241P) (1.03-198 nM, hIgG4) were concomitantly added to 100,000 HEK cells and incubated for 1 hour on ice. The extent of biotinylated PVRIG Fc binding was subsequently detected by the addition of streptavidin Alexa 647 (Jackson Laboratories) for 20-30 minutes on ice. Cells were washed twice in PBS for acquisition using a FACS Canto II. Data was analyzed using FlowJo, Excel (Microsoft), and Prism.

In the second orientation, HEK cells were engineered to express human PVRIG (HEK hPVRIG) and the ability of CHA.7.518.1.H4(S241P) and CHA.7.538.1.2.H4(S241P) (hIgG4) to inhibit soluble human PVRL2 Fc was assessed. More specifically, HEK hPVRIG cells were pre-incubated with CHA.7.518.1.H4(S241P) and CHA.7.538.1.2.H4 (S241P) (0.66-66 nM) for 30 mins on ice, after which PVRL2 mFc (human PVRL2 with a mouse Fc) was added (for 1 hr on ice) and its ability to bind HEK hPVRIG was measured. The extent of PVRL2 mFc binding was detected by the subsequent addition of goat anti-mouse Fc A647 (Jackson Laboratories) for 20-30 mins on ice. Cells were washed twice in PBS for acquisition using a FACS Canto II. Data was analyzed using FlowJo, Excel and Prism.

Cellular-based epitope space analysis: Epitope space for CHA.7.518.1.H4(S241P) and CHA.7.538.1.2.H4(S241P) was assessed on their ability to compete with another for binding to Jurkat cells. Briefly, Jurkat cells were harvested in log growth phase and stained with @@µg/ml unlabeled CHA.7.518.1.H4(S241P) and CHA.7.538.1.2.H4(S241P) for 30 mins on ice. Jurkat cells were subsequently spun down, washed, and counterstained with @µg/ml Alexa 647-labelled CHA.7.518.1.H4(S241P) and CHA.7.538.1.2.H4 (S241P) for 30 mins on ice. The competition of labelled antibodies for PVRIG binding with unlabeled antibodies on Jurkat cells was assessed by the magnitude of Alexa 647 signal by flow cytometry. Data was acquired using a FACS Canto II and analysed using FlowJo, Excel, and Prism.

Results

CHA.7.518.1.H4(S241P) and CHA.7.538.1.2.H4(S241P) recognize PVRIG on overexpressing cells, Jurkat cells, and human T cells: The ability of CHA.7.518.1.H4(S241P) and CHA.7.538.1.2.H4(S241P) humanized hybridoma-derived PVRIG antibodies to bind to human PVRIG was assessed using HEK cells that overexpress human PVRIG, Jurkat cells, and primary T cells. FIG. 20 illustrates the specificity of both CHA.7.518.1.H4(S241P) (A) and CHA.7.538.1.2.H4(S241P) (B). Both antibodies bind highly specifically to HEK hPVRIG cells, and do not bind to HEK parental cells.

Binding affinities: Both CHA.7.518.1.H4(S241P) and CHA.7.538.1.2.H4(S241P) also display binding to HEK hPVRIG cells with high affinity with their associated Kd values: 0.29 nM for CHA.7.518.1.H4(S241P) and 0.86 nM for CHA7.538.1.2 for binding to HEK hPVRIG cells.

FIG. 21 illustrates the ability of CHA.7.518.1.H4(S241P) (A) and CHA.7.538.1.2.H4(S241P) (B) to bind Jurkat cells that endogenously express PVRIG. Both are able to bind Jurkat cells with a comparable affinity to HEK hPVRIG cells.

The affinity of these antibodies to Jurkat cells are 0.15 nM for CHA.7.518.1.H4(S241P) and 0.59 nM for CHA.7.538.1.2.H4(S241P).

FIG. 22 illustrates the ability of CHA.7.518.1.H4(S241P) and CHA.7.538.1.2.H4(S241P) to bind CD8 T cells that were expanded by exposure to CMV peptide (494-503, NLVPMVATV) and endogenously express PVRIG.

CHA.7.518.1.H4(S241P) and CHA.7.538.1.2.H4(S241P) detect cynomolgus PVRIG (cPVRIG) expressed on expi cells: The ability of CHA.7.518.1.H4(S241P) and CHA.7.538.1.2.H4(S241P) to bind to cPVRIG was assessed using expi cells that overexpress cPVRIG. FIG. 23 illustrates the specificity of both CHA.7.518.1.H4(S241P) (A) and CHA.7.538.1.2.H4(S241P) (B). Both antibodies bind highly specifically to expi cPVRIG cells, and do not bind to expi parental cells. Both CHA.7.518.1.H4(S241P) and CHA.7.538.1.2.H4(S241P) also display binding to expi cPVRIG cells with high affinity with their associated Kd values of 0.24 nM for CHA.7.518.1.H4(S241P) and 0.58 nM for CHA7.538.1.2.

Cellular-based receptor-ligand blocking assays: The ability of CHA.7.518.1.H4(S241P) and CHA.7.538.1.2.H4 (S241P) to inhibit the interaction of PVRIG with PVRL2 was assessed in two orientations, as outlined in the protocols section. In the first permutation, both CHA.7.518.1.H4 (S241P) and CHA.7.538.1.2.H4(S241P) were able to completely inhibit the binding of PVRIG Fc to HEK cells (FIG. 24A). The IC50 values associated with this blocking capacity are 15 nM for CHA.7.518.1.H4(S241P) and 16.1 nM for CHA.7.538.1.2.H4(S241P). Importantly, not all the antibodies derived from the hybridoma campaign confirmed to bind to PVRIG were able to block the binding of PVRIG Fc to HEK cells. As shown in FIG. 24B, an antibody done designated CHA.7.544 is unable to block the binding of PVRIG Fc to HEK cells.

In the second permutation, both CHA.7.518.1.H4(S241P) and CHA.7.538.1.2.H4(S241P) were also able to completely inhibit the binding of PVRL2 Fc to HEK hPVRIG cells (FIG. 25A). The IC50 values associated with this inhibition are 1.8 nM for CHA.7.518.1.H4(S241P) and 2.53 nM for CHA.7.538.1.2.H4(S241P). Although the ability of CHA.7.518.1.H4(S241P) and CHA.7.538.1.2.H4(S241P) were able to completely inhibit PVRL2 Fc binding in this permutation, consistent with their ability to inhibit PVRIG Fc binding in the first permutation, other antibodies did not show this same trend. More specifically, another humanized hybridoma-derived antibody, CHA.7.530.3, that was able to completely inhibit binding of PVRIG Fc to HEK cells (first permutation, data not shown), was not able to completely inhibit binding of PVRL2 Fc binding to HEK hPVRIG cells (FIG. 25A). Collectively, this data indicates that the second permutation of the cellular-based receptor ligand blocking assay is able to distinguish potency of receptor-ligand blocking antibodies with more sensitivity compared to the first permutation. Importantly, CHA.7.544 was shown to be unable to block the binding of PVRL2 Fc to HEK hPVRIG cells (FIG. 25B) consistent with its inability to block PVRIG Fc binding to HEK cells.

Cellular-based epitope space analysis: As outlined in the protocols section, an analysis of the epitope space of CHA.7.518.1.H4(S241P) and CHA.7.538.1.2.H4(S241P) was conducted by assessing their ability to compete for PVRIG binding. FIG. 26 shows the ability of unconjugated versions of the antibodies to inhibit binding of the Alexa 647 (A647) conjugated versions of the same antibodies. The data in the FIG. 26 depicts the percentage binding of A647 conjugated antibodies relative to the maximum signal they yield with no competition. The signal yielded from CHA.7.518.1.H4(S241P) A647 and CHA.7.538.1.2.H4 (S241P) A647 was not affected by pre-incubation of the Jurkat cells with isotype control (data not shown). As expected, the signal yielded from CHA.7.518.1.H4(S241P) A647 and CHA.7.538.1.2.H4(S241P) A647 was significantly reduced when in competition with unconjugated versions of themselves (data not shown). Interestingly, upon analysis of A647 signal from CHA.7.518.1.H4(S241P) and CHA.7.538.1.2.H4(S241P) in the context of pre-incubation with the unconjugated version of the opposite antibody, there was also significant reduction. This indicates that CHA.7.518.1.H4(S241P) and CHA.7.538.1.2.H4(S241P) may share a similar epitope space on endogenously expressed PVRIG.

Summary and Conclusions: Mouse versions of anti-PVRIG antibodies designated CHA.7.518 and CHA.7.538 were successfully humanized into a human IgG4 isotype (CHA.7.518.1.H4(S241P) and CHA.7.538.1.2.H4(S241P)) which retained binding properties towards the human PVRIG antigen. Using engineered over-expressing cells, Jurkat, and CMV expanded primary CD8 T cells, CHA.7.518.1.H4(S241P) and CHA.7.538.1.2.H4(S241P) were shown to be highly specific to endogenous human PVRIG and bound with high affinity. Furthermore, CHA.7.518.1.H4(S241P) and CHA.7.538.1.2.H4(S241P) also showed reactivity to cyno PVRIG antigen and bound to over-expressing cells with high affinity. Functionally, CHA.7.518.1.H4(S241P) and CHA.7.538.1.2.H4(S241P) were able to inhibit the interaction of PVRIG with PVRL2 in FACS-based assays. Lastly, CHA.7.518.1.H4(S241P) and CHA.7.538.1.2.H4(S241P) were shown to potentially share epitope space on endogenous human PVRIG due to their ability to compete with one another for binding to Jurkat cells.

F. Example 6: Humanized Antibodies: Functional Analysis of Humanized Antibodies

The functional activity of several humanized antibodies of the invention was validated.

CHO-S OKT3 assay: The CHO-S OKT3 assay was utilized to determine whether the humanized PVRIG antibodies, CHA.7.518.1.H4(S241P) and CHA.7.538.1.2.H4 (S241P), could enhance CD4+ and CD8+ T cell proliferation, and cytokine secretion. The target cells used in the co-culture assay were the Chinese hamster ovary cell line, CHO-S (ATCC), either stably overexpressing the single chain variable fragment of the anti-human CD3 antibody Clone OKT3 (abbreviated as OKT3), or stably overexpressing both OKT3 and human PVRL2 (abbreviated as hPVRL2). CHO-S OKT3 parental cells were grown in serum-free CD-CHO medium (Gibco) supplemented with 40 mM glutamax (Gibco), penicillin/streptomycin (Gibco), and 6 µg/ml puromycin (Gibco). CHO-S OKT3 hPVRL2 cells were grown in the same CD-CHO medium as the parental cells, but also supplemented with 600 µg/ml hygromycin B (Gibco).

Primary CD4+ and CD8+ T cells were isolated from healthy human donors using the RosetteSep™ human CD4+ T cell enrichment cocktail (Stemcell Technologies), and the human CD8+ microbeads (Miltenyi Biotec), respectively, and frozen in liquid nitrogen. On the day of the co-culture assay, CD4+ or CD8+ T cells were thawed, counted, and labeled with 1 µM CFSE (Life Technologies) for 10 minutes at 37° C. Following this incubation, T cells were washed and resuspended in complete medium containing RPMI (Gibco), supplemented with 10% heat-inactivated FBS, glutamax, penicillin/streptomycin, non-essential amino acids (Gibco), sodium pyruvate (Gibco), and 50 µM β-mercaptoethanol (Gibco). CHO-S OKT3 and CHO-S OKT3 hPVRL2 cells were harvested from culture, and treated with mitomycin C (Sigma-Aldrich) for 1 hour at 37° C. with periodic mixing. After the incubation, the target cells were thoroughly washed, counted, and resuspended in complete RPMI medium. The assay was set up with a 5:1 ratio of T cells (100,000) to target cells (20,000). The target cells, T cells, and 10 µg/ml of each antibody treatment were added together in a 96-well U-bottom plate (Costar), and incubated for either 3 days (CD8+ T cells), or 5 days (CD4+ T cells) at 37° C. The PVRIG antibody treatments included human CHA.7.518.1.H4(S241P) IgG4, human CHA.7.538.1.2.H4 (S241P) IgG4, human CHA.7.530.3 IgG4 (partial receptor/ligand blocking antibody), and mouse CHA.7.544 IgG1 (non-receptor/ligand blocking antibody). In addition to the PVRIG antibodies, the activity the mouse anti-human DNAM-1 IgG1 (Clone DX11, BioLegend), mouse IgG1 isotype control (Clone MOPC21, BioLegend), and a human IgG4 isotype control was also assessed. For antibody dose-titrations, 3-fold dilutions from 66 nM to 0.264 nM of the PVRIG antibodies, and the respective isotype control antibody were utilized.

After the 3 or 5-day incubation period, co-culture supernatants were analyzed for secreted cytokines, including IL-2, IL-4, IL-5, IL-6, IL-9, IL-10, IL-13, IL-17A, IL-17F, IL-21, IL-22, TNFα, and IFNγ, with the cytometric bead array (CBA) human Th1/Th2/Th17 cytokine kit (BD Biosciences), or with the LEGENDplex™ Human Th cytokine kit (BioLegend). T cell proliferation was measured by staining CD4+ or CD8+ T cells with the LIVE/DEAD fixable aqua dead cell stain kit (ThermoFisher Scientific), anti-CD4 antibody (Clone RPA-T4, BioLegend), and anti-CD8 antibody (Clone HIT8a, BioLegend), and gating on the percentage of live, CFSE low proliferating CD4+ or CD8+ T cells. Data was acquired using a FACS Canto II (BD Biosciences), and analyzed using FlowJo (Treestar) and Prism (Graphpad) software.

Results

CHA.7.518.1.H4(S241P) and CHA.7.538.1.2.H4(S241P) Enhance CD4+ T Cell Proliferation in a hPVRL2-Dependent Manner:

The ability of the CHA.7.518.1.H4(S241P) and CHA.7.538.1.2.H4(S241P) humanized hybridoma-derived PVRIG antibodies to enhance primary CD4+ T cell proliferation in vitro was assessed with the CHO-S OKT3 assay. FIG. 27A shows the percentage proliferating CD4+ T cells from a representative donor in response to co-culture with the CHO-S OKT3 hPVRL2 target cells and different PVRIG antibodies. In this donor, humanized CHA.7.518.1.H4 (S241P) and CHA.7.538.1.2.H4(S241P) antibodies increase CD4+ T cell proliferation compared to the human IgG4 isotype control (dashed line). The partial receptor/ligand blocking antibody, human CHA.7.530.3 IgG4 only weakly enhances T cell proliferation, while the non-receptor/ligand blocking antibody, mouse CHA.7.544 IgG1 has no effect compared to the isotype control antibodies. The anti-DNAM-1 antibody reduces CD4+ T cell proliferation. FIG. 27B demonstrates that the effects of the humanized CHA.7.518.1.H4(S241P) and CHA.7.538.1.2.H4(S241P) PVRIG antibodies, and the anti-DNAM-1 antibody are dependent on hPVRL2 overexpression on the target cells. Following CHA.7.518.1.H4(S241P) and CHA.7.538.1.1 antibody treatment, a greater increase in CD4+ T cell proliferation is observed when the CD4+ T cells are co-cultured with the CHO-S OKT3 hPVRL2 cells, compared to co-culture with the CHO-S OKT3 parental cells. Similarly, the anti-DNAM-1 antibody only decreases CD4+ T cell proliferation when T cells are co-cultured with the hPVRL2-expressing CHO-S OKT3 cells.

CHA.7.518.1.H4(S241P) and CHA.7.538.1.2.H4(S241P) enhance CD8+ T cell proliferation and IFN-g secretion: FIG. 28A-B illustrate the ability of humanized PVRIG antibodies, CHA.7.518.1.H4(S241P) and CHA.7.538.1.2.H4(S241P), to increase CD8+ T cell proliferation in the CHO-S OKT3 assay. In two different human CD8+ T cell donors, CHA.7.518.1.H4(S241P) and CHA.7.538.1.2.H4(S241P) antibodies increase CD8+ T cell proliferation compared to the human IgG4 isotype control when T cells are co-cultured with the CHO-S OKT3 hPVRL2 cells. However, the mouse CHA.7.544 IgG1 has little to no effect. As observed with the CD4+ T cells, the anti-DNAM-1 antibody reduces CD8+ T cell proliferation. FIG. 28C shows that the humanized PVRIG antibodies, CHA.7.518.1.H4(S241P) and CHA.7.538.1.2.H4(S241P) also enhance IFNγ secretion in the CHO-S OKT3 assay. In three different human CD8+ T cell donors, CHA.7.518.1.H4(S241P) and CHA.7.538.1.2.H4(S241P) antibodies increase IFNγ production compared to the human IgG4 isotype control (dashed line). Increases in IL-10, IL22 and TNFα were also observed following CHA.7.518.1.H4(S241P) and CHA.7.538.1.2.H4(S241P) antibody treatment (data not shown).

CHA.7.518.1.H4(S241P) and CHA.7.538.1.2.H4(S241P) consistently enhance CD4+ T cell proliferation across multiple human donors: Next, to demonstrate that the CHA.7.518.1.H4(S241P) and CHA.7.538.1.2.H4(S241P) antibodies could reproducibly enhance T cell function, the effects of the humanized PVRIG antibodies on CD4+ T cell proliferation were examined across 11 different donors in the CHO-S OKT3 assay. FIG. 29 demonstrates that both CHA.7.518.1.H4(S241P) and CHA.7.538.1.2.H4(S241P) consistently increased CD4+ T cell proliferation in the majority of the tested donors compared to the human IgG4 isotype control antibody when T cells were co-cultured with the CHO-S OKT3 hPVRL2 cells. Furthermore, the partial receptor/ligand blocking antibody, CHA.7.530.3, and the non-receptor/ligand blocking antibody, CHA.7.544, do not consistently enhance CD4+ T cell proliferation across the same donors.

CHA.7.518.1.H4(S241P) and CHA.7.538.1.2.H4(S241P) have a dose-dependent effect on CD4+ and CD8+ T cell proliferation: Finally, the dose-dependent effect of the humanized PVRIG antibodies, CHA.7.518.1.H4(S241P) and CHA.7.538.1.2.H4(S241P) was measured in the CHO-S OKT3 assay. Decreasing the dose of the CHA.7.518.1.H4 (S241P) and CHA.7.538.1.2.H4(S241P) antibodies lowers the percent of CD4+ T cell (FIG. 30A), and CD8+ T cell (FIG. 30B) proliferation when the T cells are co-cultured with the CHO-S OKT3 hPVRL2 cells. This dose-dependent effect on T cell proliferation is not observed with the CHA.7.544 antibody, nor the IgG4 isotype control. Furthermore, no biphasic effect with the dose titration was observed, suggesting a lack of agonist activity of the humanized PVRIG antibodies.

Summary and Conclusions

Humanized PVRIG antibodies, CHA.7.518.1.H4(S241P) and CHA.7.538.1.2.H4(S241P), had in vitro functional activity in the primary cell-based CHO-S OKT3 assay. CHA.7.518.1.H4(S241P) and CHA.7.538.1.2.H4(S241P) both increased CD4+ and CD8+ T cell proliferation in a dose-dependent manner. CHA.7.518.1.H4(S241P) and CHA.7.538.1.2.H4(S241P) were also capable of augmenting IFNγ secretion in the CHO-S OKT3 assay. It was shown that the activity of the CHA.7.518.1.H4(S241P) and CHA.7.538.1.2.H4(S241P) antibodies was dependent on overexpression of hPVRL2 on target cells. CHA.7.518.1.H4 (S241P) and CHA.7.538.1.2.H4(S241P) consistently enhanced T cell activity across multiple human donors, while the non-blocking CHA.7.544 antibody had little to no effect.

G. Example 7: Development of Rat Monoclonal Antibodies for Mouse PVRIG

Development of rat monoclonal antibodies (mAbs) was performed at Aldevron Freiburg (Germany). Antibodies against mouse PVRIG protein were raised by using DNA immunization technology. Immunization vector expressing mouse PVRIG introduced into the host organism (rat). Mouse PVRIG was expressed, and an immunization response was generated. Positive antisera identification and hybridomas screening were analyzed on cells transiently express mouse PVRIG.

Rat Anti-Mouse PVRIG pAb Generation

Development of rat polyclonal antibodies against mouse PVRIG protein included cloning of mouse PVRIG extracellular domain into Aldevron proprietary immunization vector, and cloning of the full length and the extracellular domain into Aldevron proprietary screening vectors. The various expression vectors used for immunizations and for screening were confirmed by FACS on cells transiently express mouse PVRIG. Three rats were then immunized with the immunization vector. Immune sera were taken and diluted sera were tested by FACS using cells transiently transfected with the screening vectors. Production bleeds from each rat were collected, and purification using protein-A was performed.

Rat Anti-Mouse PVRIG mAb Generation

Fusion of rat lymphocytes and selection using Aldevron's test systems were performed. This included: Fusion of 20×96-well plates followed by initial screening by Cell Based ELISA (cELISA), on transiently transfected cells with mouse PVRIG ECD (extracellular domain) or FL (full length). 108 positive clones (bound to cells expressing mouse PVRIG ECD\FL) were further propagated and retested. 30 positives clones were propagated into T-25 flasks and the supernatants were tested in cell based ELISA. 23 hybridoma clones were selected for further subcloning. Serum free supernatant was tested by cELISA and by FACS. Total of 21 clones were generated and binding was confirmed on cells over expressing the mouse PVRIG protein.

Abs Characterization

Binding of the rat anti mouse PVRIG test bleeds, purified pAb, pre-clonal and clonal supernatants as well as the purified mAbs, was analyzed by Flow Cytometry, using stable HEK293 cells over expressing the mouse PVRIG. The binding of the antibodies to D10.G4.1 cells endogenously expressing mouse PVRIG was also tested. Specific cell surface expression of mouse PVRIG was confirmed. Cells ($1-2\times10^5$) were stained with Fixable viability stain diluted 1:1000 in PBS, for 10 min at R.T. followed by cells washing with PBS. The Abs were then added to cells (diluted in FACS buffer) followed by staining with goat anti rat-PE (diluted 1:100 in FACS buffer).

mAbs specificity was tested by siRNA for PVRIG transfection of D10.G4.1 cell line endogenously expressing mouse PVRIG. Reduction in cell surface was observed following mouse PVRIG knockdown.

mAbs Binding to NK Cells was also Tested by FACS.

Binning Assay was Performed to Demonstrate mAbs Diversity.

Affinity of the purified mAbs (Kd) was determined by FACS titration on stable cells over expressing the mouse PVRIG versus empty vector transduced cells, and on D10.G4.1 cell line. Cells ($1\times10^5$) were stained with Fixable viability stain diluted 1:1000 in PBS, for 10 min at RT followed by cells washing with PBS. The Abs were then added to cells (8 concentrations—series dilution 1:3, 10-0.01 µg/ml diluted in FACS buffer) followed by staining with Goat Anti rat-PE (diluted 1:100 in FACS buffer).

mAbs Characterization—Summary Table

Table 7 (columns 1-10) summarize the data generated for the characterization of the anti-mouse PVRIG antibodies.

Column 1 represent the Ab code ID

Column 2 represent the Ab name provided by Aldevron

Column 3 represent FACS data as MFI ratio on stable over expressing cells over empty vector transduced cells at 10 µl/ml mAb concentration Column 4 represent affinity (nM) on the over expressing HEK cells Column 5 represent binding to NK cells at 10 ug\ml mAb concentration Column 6 represent MFI ratio of binding of D10.G4.1 cell line over isotype control Column 7 represent affinity (nM) to D10.G4.1 cell line Column 8 represent the various bins in the epitope binning assay Column 9 represent % Receptor-Ligand blocking assay (mouse PVRIG-Fc fusion protein binding to mouse PVRL2 over expressing cells) and IC50 (nM)

Column 10 represent % Receptor-Ligand blocking assay (mouse PVRL2-Fc fusion protein binding to mouse PVRIG over expressing cells) and IC50 (nM)

AB-406 and AB-407 demonstrated blocking activity in both Receptor-Ligand binding assays have relative high affinity, binds to NK and to D10.G4.1 cells.

These Abs were selected for TME expression and for in vivo studies.

TABLE 7

Anti-mouse PVRIG monoclonal Abs characterization.

| LIMS ID | Ab name | MFIr (HEK OX\EV) 10 ug/ml | Kd (nM) On OX Cells | Expression in NK MFIr (Ab\Iso) | Expression in D10.G4.1 MFIr (Ab\Iso) | Kd (nM) On D10.G4.1 Cells | Epitop Binning | % R-L blocking (029-Fc) (IC50) | % R-L blocking (mPVRL2-Fc) (IC50) |
|---|---|---|---|---|---|---|---|---|---|
| AB-400 | BOJ-1F11-H6 | 10 | 0.1393 | NT | 13.2 | 35.68 | 1 | Agonist | Agonist |
| AB-401 | BOJ-3E2-F4 | 55.7 | 2.4 | NT | 7.5 | NT | 1 | Agonist | inconsistent |
| AB-402 | BOJ-4F11-H6 | 4.8 | 0.08974 | NT | 20 | NT | 1 | Agonist | Agonist |
| AB-403 | BOJ-4G1-E3 | 28 | 57.64 | — | 2 | NT | 4 | 78% (2.782) | Inconsistent |
| AB-404 | BOJ-4H8-E3 | 18.6 | 0.386833 | 1.5 | 6.8 | NT | 1 | Inert | 93-98% |
| AB-405 | BOJ-5A4-E3 | 13.5 | 0.08871 | NT | 6.7 | 4.596 | 1 | Agonist | Agonist |
| AB-406 | BOJ-5C7-B3 | 54.5 | 1.884667 | 2.2 | 10 | 8.577 | 3 | 77% (3.679) | 97-100% |
| AB-407 | BOJ-5G4-F4 | 50 | 0.334427 | 2.8 | 8 | 1.325 | 3 | 95% (3.992) | 95-100% |
| AB-408 | BOJ-8G1-G1 | 18.9 | 5.098 | 1.7 | 8 | NT | 4 | 90% (3.585) | Agonist |
| AB-409 | BOJ-9B1-D9 | 24.8 | 0.1555 | NT | 10 | NT | 1 | Agonist | inconsistent |
| AB-410 | BOJ-11C2-G9 | 16.6 | 0.2218 | 2.4 | 6.8 | NT | 1 | Agonist | inconsistent |
| AB-411 | BOJ-12E2-F8 | 36 | 5.3405 | NT | 5.4 | NT | 3 | 94% (4.311) | 96-100% (1.189) |
| AB-412* | BOJ-14H2-F4 | 3.3* | NT | NT | 2 | NT | 2 | Agonist | 62-67% (23.87) |
| AB-413* | BOJ-15B3-E11 | 49.3 | 1.09345 | 2.1 | 12 | 4.693 | 3 | 73% (2.836) | 95-100% (0.58) |
| AB-414 | BOJ-15F8-C6 | 24.8 | 2.0395 | 1.6 | 8.5 | 16.48 | 3 | 90% (2.907) | 95-100% (1.164) |
| AB-415 | BOJ-16E7-G8 | 24 | 17.573 | 2.2 | 5 | NT | 5 | 95% (6.727) | 95-100% (5.643) |
| AB-416 | BOJ-17C4-D4 | 26.3 | 6.357 | 1.5 | 5 | NT | 1 | Inert | 92-94% (1.963) |
| AB-417* | BOJ-17C7-H5 | 15 | 59.16 | — | 2.5 | NT | 4 | 72% (3.455) | Inert |
| AB-418 | BOJ-18C1-C10 | 64.8 | 62.98 | NT | 4.4 | NT | 5 | 94% (18.18) | 100% (8.055) |
| AB-419 | BOJ-18D2-F5 | 17 | 0.3169 | 1.5 | 6.3 | NT | 1 | Agonist | 57-64% |
| AB-420 | BOJ-19D9-C7 | 33.6 | 3.172 | 1.2 | 20 | NT | 4 | 78% (9.805) | Agonist |

H. Example 8: Combination Testing with Additional Immune Checkpoint Inhibitors Background While antibody blockade of the CTLA4 and PD1 pathways has emerged as an effective treatment modality for cancer, the majority of patients do not derive long term benefit, suggesting a need for targeting of additional immune checkpoints. Employing our unique computational algorithms to define new members of the B7/CD28 family we identified PVRIG, which is expressed by multiple subsets of T and NK cells. We report here its expression pattern, functional characterization, and anti-tumor activity of blocking antibodies targeting this molecule.

Methods

Utilizing the Predictive Discovery platform PVRIG was identified as a potential novel immune checkpoint, after which a retroviral cell screening library was used to identify its cognate binding counterpart. Target effects on T-cell modulation were assessed with primary and tumor-derived T-cell assays, taking advantage of target overexpression, knockdown, and antagonist antibody approaches. Antibodies against the human protein were screened for their ability to enhance T-cell activation in vitro, while antibodies targeting the mouse orthologue were assessed in vivo for effects on tumor growth inhibition in syngeneic models Results A PVRIG-Fc-fusion protein was found to bind PVRL2, with binding specificity confirmed both by ELISA and flow cytometry analysis. PVRIG demonstrated unique expression kinetics upon T-cell activation, with detection of the target on memory T-cells, as well as on NK cells and γδ T-cells. A panel of high affinity human antibodies with the ability to block interaction of PVRIG with PVRL2 were generated, which when tested in vitro were shown to enhance activation of both primary CD4+ and tumor-derived CD8+ T-cells through a PVRL2-dependent mechanism.

Since CHA.7.518.1.H4(S241P) is not mouse cross-reactive, in vivo studies were conducted with a surrogate blocking anti-mouse PVRIG antibody. When combined with anti-PDL-1 blockade, anti-mouse PVRIG inhibits growth of established tumors in both the CT26 and MC38 colorectal cancer models. Combination testing with additional immune checkpoint inhibitors, as well as in PVRIG knockout mice, is ongoing Conclusions High affinity antagonistic antibody, is able to enhance human T-cell activation, and a surrogate antibody with similar characteristics shows synergy with PD-L1 in vivo in multiple syngeneic models. Overall, our data demonstrates the utility of targeting PVRIG in addition to other B7 family checkpoints for the treatment of cancer

I. Example 9: In Vivo POC Study: Efficacy of Anti mPVRIg mAbs in CT26 Tumor Model This example describes the efficacy of anti mPVRIg mAbs treatment in CT26 murine colon carcinoma model as mono-therapy or in combination with anti-PDL-1 treatment.

Materials and Methods

Tumor Challenge Experiments:

CT26 colon carcinoma was purchased from ATCC (CRL-2638). Cells were cultured in RPMI 1640 (Biological Industries, 01-100-1A) with 10% FBS (Biological Industries, 04-127-1A), and 100 μg/mL penicillin/streptomycin (Biological Industries, 03-031-1B). For tumor implantation, cells were harvested and washed, counted and suspended to $10^7$ cells/ml in cold RPMI 1640 and placed in ice. BALB/c mice ((female, 8 wk) Envigo), were anesthetized with 10% Ketamine (Clorketam; SAGARPA Q-7090-053) and 10% Xylazine (Sedaxylan; BE-V254834) mixture injected intraperitoneal. Next, the back of the mice was shaved and disinfected with a 70% Ethanol solution. Tumor cells were injected as 50 μL of $5\times10^5$ CT26 cells subcutaneously into the back right flank of mice. The mAb administration started at day 4 (Mono treatment) or day 7 (Combo treatment) post tumor inoculation when tumors were at volume of 30-50 mm$^3$ (Mono treatment) or reached the volume of 60-90 mm$^3$ (Combo treatment); and was given intra-peritoneal (i.p.) in a final volume/injection of 200 ul, for 3 wks for a total of 6 administrations. Tumor growth was measured with electronic caliper every 2-3 days and was reported as $0.5\times W^2 \times L$ mm$^3$. Mice were sacrificed with $CO_2$ at either study termination or any of the following clinical endpoints: tumor volume≥2250 mm$^3$, tumor ulceration, body weight loss≥20%, or moribund appearance Antibodies:

The chimeric anti-mouse PVRIg antibodies (mAb 406 and mAb 407) used in this study, engineered as a Rat IgG2b isotype monoclonal antibody (mAb) were shown to bind to 293HEK transfectants expressing mPVRIg and block binding of mPVRL2 to these cells. The mIgG1 anti-mouse PDL-1 inhibitor used in this study was mAb YW243.55.S70. The YW243.55.S70 antibody is an anti-PD-L1 described in WO 2010/077634 (heavy and light chain variable region sequences shown in SEQ ID Nos. 20 and 21, respectively, of WO 2010/077634), and having a sequence disclosed therein.

All mAbs were formulated in sterile PBS and were low in endotoxin (<0.05 EU/mg).

TABLE 8

Tested mAbs.

| | | | |
|---|---|---|---|
| 1 | Mouse IgG1, k Isotype Ctrl. (MOPC-21) | BP0083 | BioXcell |
| 2 | Rat IgG2b, k Isotype Ctrl. (LTF-2,) | BP0090 | BioXcell |
| 3 | Benchmark anti PDL-1 (mIgG1) | YW243.55.S70 | Compugen inc. |
| 4 | Anti CGEN PVRIG mAb 406 (Rat IgG2b) | BOJ-5C7-B3 | ALDEVERON |
| 5 | Anti CGEN PVRIG mAb 407 (Rat IgG2b) | BOJ-5G4-F4 | ALDEVERON |

Study Design

Mono Treatment

Eight weeks old BALB/c female mice were purchased from Envigo and maintained in an SPF animal facility for 1 week prior to beginning the experiment. Mice were anesthetized, shaved and inoculated subcutaneously with 50 μl of $5\times10^5$ CT26 tumor cells. At day 4 post tumor inoculation, mice were randomly assigned into treatment groups of n=10 (as described below). Mice were treated with mAbs (as detailed below) injected on day 4, 7, 11, 14, 18 and 21 post inoculation. Tumor growth was measured with caliper every 2-3 days.

TABLE 9

Treatment groups.

| # Group | Treatment/mAb | Dose (mg/Kg) | # Dose | Vol/Dose (ul) |
|---|---|---|---|---|
| 1 | Vehicle | | 6 | 200 |
| 2 | mIgG1 iso Ctrl | 5 | 6 | 200 |

TABLE 9-continued

Treatment groups.

| # Group | Treatment/mAb | Dose (mg/Kg) | # Dose | Vol/Dose (ul) |
|---|---|---|---|---|
| 3 | Rat IgG2b iso Ctrl | 10 | 6 | 200 |
| 4 | Anti-PDL-1 mIgG1 | 5 | 6 | 200 |
| 5 | Anti-mPVRIg mAb 406 rIgG2b | 10 | 6 | 200 |
| 6 | Anti-mPVRIg mAb 407 rIgG2b | 10 | 6 | 200 |

Combo Treatment

For Combo of anti-mPVRIg and anti-mPDL-1 mAbs treatments. Mice were treated as described in the Mono treatments. At day 7 post tumor inoculation, mice were randomly assigned into treatment groups of n=10 as described below. Mice were treated with mAbs (as detailed below) injected on day 7, 11, 14, 18, 21 and 25 post tumor inoculation.

TABLE 10

Treatment dosages.

| # Group | Treatment/mAb 1 | Dose (mg/Kg) | Treatment/mAb 2 | Dose (mg/Kg) | # Dose | Vol/Dose (μl) |
|---|---|---|---|---|---|---|
| 7 | mIgG1 iso Ctrl | 5 | Rat IgG2b iso Ctrl | 10 | 6 | 200 |
| 8 | Anti-PDL-1 mIgG1 | 5 | Rat IgG2b iso Ctrl | 10 | 6 | 200 |
| 9 | Anti-PDL-1 mIgG1 | 5 | Anti-mPVRIg mAb 406 rIgG2b | 10 | 6 | 200 |
| 10 | Anti-PDL-1 mIgG1 | 5 | Anti-mPVRIg mAb 407 rIgG2b | 10 | 6 | 200 |

Statistical Analysis:

Two-way ANOVA with repeated measures, followed by two way ANOVA with repeated measures for selected pairs of groups using JUMP (Statistical Discoveries™) software. Analyses of tumor growth measurements were performed by comparing tumor volumes measured on the last day on which all study animals were alive. Statistical differences in percentage of mice tumor free were determined by a Log Rank Mantel-Cox test. Values of P<0.05 were considered significant.

* p<0.05;  p<0.01; * p<0.001. For each experiment, the number of replicates performed and the number of animals per group are described in the corresponding figure legend(s) (FIGS. 47-48).

Results

Monotherapy Activity of Anti-mPVRIg and Anti-mPDL-1 in Syngeneic CT26 Tumor Model We began preclinical assessment of anti-mPVRIg and anti-mPDL-1 monotherapy in mouse syngeneic CT26 tumor model. We treated mice with a mIgG1 isotype anti-PDL-1 antibody (YW243.55.S70) or with rIgG2b isotype anti-mPVRIg (mAbs 406 and 407).

In a semi-therapeutic treatment model of CT26 colon carcinoma, mono therapy with anti-PDL-1 was significantly efficacious (P<0.0001), eliciting a 70% of TGI compared to control mIgG1 isotype, greater rates of tumor rejection with rapid tumor rejection and durable antitumor immunity observed in a majority of mice (FIGS. 63A+B).

Groups treated with either anti mPVRIg mAb 406, and anti-mPVRIg mAb 407 showed similar tumor growth rates with no TGI over rIgG2b isotype (FIGS. 63A+B). Accordingly, anti-PDL-1 mIgG1 treatment prolonged the survival of mice (P<0.01, FIG. 63C), with 5 out of 10 individuals demonstrating a complete tumor clearance (FIG. 63B). No effect of anti-mPVRIg mAbs on survival rates was observed.

Activity of Anti-PVRIg and anti-PDL-1 Combination in Syngeneic Mouse Tumor Model Next, we assessed the activity of anti-PVRIg and anti-PDL-1 combination therapy in mouse syngeneic tumor model.

In a therapeutic treatment model of CT26 colon carcinoma, administration of anti-PDL-1 with control rIgG2b isotype treatment, initiated on day 7 post inoculation, was not efficacious, while combination of anti-PVRIg mAb 407 with anti-PDL-1 elicited significant TGI (56%, P=0.0005), higher rates of tumor rejection with 4 out of 10 individuals demonstrating a complete tumor clearance (FIGS. 64A+B) and promoted better antitumor activity, with durable antitumor immunity detected (P<0.01, FIG. 64C). Combination of anti-PVRIg mAb 406 with anti-PDL-1 was partially efficacious, resulting a 33% of TGI, however, the anti-tumor response recorded was transient and no effect on survival rate was observed.

Conclusions

The mPVRIg was predicted to play a role as a novel B7-like molecule and thus as a potential target for antibody based cancer immunotherapy. Several human in vitro experimental systems have demonstrated an immune-modulatory effect for mPVRIg. In the studies presented in this report we have evaluated the in vivo anti-cancer effect of mAbs directed against mPVRIg. In our study, treatment with 10 mg/kg (200 ug/mouse) of anti-mPVRIg as monotherapy in a minimal disease set-up, i.e. treatment initiation on day 4 (tumor mean of 40 mm$^3$), did not result in TGI or survival advantage while positive control anti-PDL-1 mAb exhibited significant TGI and resulted prolonged survival.

Anti-mPVRIg mAbs were tested also in combination with anti-PDL-1 treatment. Treatment with 10 mg/kg (200 ug/mouse) was initiated on day 7, when tumors reach an average size of 75 mm$^3$. Combination therapy of Anti-mPVRIg mAb 407 with anti-PDL-1 in therapeutic CT26 model exhibited tumor growth inhibition and prolonged survival of treated mice. The effect on tumor growth varied between individual mice with some individuals demonstrating a complete tumor clearance while other individuals exhibiting partial response (transient TGI) and some individuals were not responsive. An in vivo effect of anti-mPVRIg and anti-mPDL-1 combination treatment was also shown in MC38 and B16-D$^b$/gp100 tumor models (data not shown).

Additional in vivo studies are planned to assess dose dependencies and efficacy in additional syngeneic models or in combination with additional treatment compounds or regimens.

J. Example 10: TIGIT Therapeutic Antibody Discovery by Phage Display

1. Introduction

A phage display antibody discovery campaign was conducted to isolate human TIGIT binders from a naïve human fab library using recombinant human TIGIT extra-cellular domain as target antigen. Forty-five novel human TIGIT-specific antibodies were isolated and generated as human IgG4, inclusive of an optional S241P in the hinge region as discussed herein. The resulting antibodies were screened for their ability to block the TIGIT-PVR interaction and for cross-reactivity with cell-expressed cynomolgus TIGIT by flow cytometry. Two of these antibodies were further optimized for higher human and cynomolgus TIGIT binding affinity.

2. Protocols

Antigens for Antibody Discovery by Phage Display:

Two formats of human TIGIT protein were used as antigens in phage display. The first comprised of the human TIGIT ECD (Met22-Pro141) fused to a C-terminal polyhistidine tag (hTIGIT-HIS) and was either generated in-house or sourced commercially from Sino Biological Inc. The second antigen format comprised of the human TIGIT ECD fused to a human IgG1 Fc domain at the C-terminus (hTIGIT-hFc) and was either generated in-house or sourced commercially from R&D Systems.

Functional QC of Antigens:

The recombinant TIGIT antigens used for biopanning were functionally validated by their ability to bind to human PVR, the ligand of human TIGIT. Biotinylated antigens were tested for PVR binding, either by ELISA or flow cytometry. Biotinylated hTIGIT-HIS was validated by its ability to bind hPVR-hFc (Sino Biological Inc.) by ELISA. Biotinylated hTIGIT-hFc was validated by flow cytometry for its ability to bind endogenously surface expressed PVR on Expi293 cells.

Phage Panning of Human Antibody Library:

Two phage campaigns, utilizing either human TIGIT-HIS (campaign 1) or human TIGIT-hFc (campaign 2) as antigens, were executed. Panning reactions were carried out in solution, using streptavidin-coated magnetic beads to display the biotinylated TIGIT antigens. Both campaigns used a human fab antibody phage display library for initial discovery. Three rounds of panning were carried out using the respective human TIGIT antigens, with higher wash stringency and lower antigen concentrations in each successive round of panning. Antibody CPA.9.002, generated in campaign 1, was optimized for improved human TIGIT binding by generating a phage library by saturation mutagenesis of L-CDR3 and panning the resulting library against human TIGIT-HIS (campaign 3). Two antibodies, CPA.9.059 and CPA.9.027, generated in campaigns 2 and 3, respectively, were also optimized for improved human TIGIT affinity and cyno TIGIT cross-reactivity (campaign 4). For each antibody, a phage library was generated by saturation mutagenesis of two CDRs (any combination of H-CDR1, H-CDR2, H-CDR3, L-CDR1, or L-CDR3). The resulting phage libraries were panned for four rounds against human TIGIT-HIS and C-terminal HIS-tagged cyno TIGIT ECD recombinant protein in alternating rounds of panning. The panning antigens used were as follows: 1 nM human TIGIT-HIS in round 1, 1 nM cyno TIGIT-HIS in round 2, 0.1 nM human TIGIT-HIS in round 3, and 0.1 nM cyno TIGIT-HIS in round 4.

Binding Screens Using Antibodies Expressed as Fab Fragments:

The phagemid construct contains an amber stop codon that allows it to function as a fab expression vector. Transformation of these vectors into *E. coli* and induction with isopropyl β-D-1-thiogalactopyranoside (IPTG) results in periplasmic expression of soluble fab molecules. Fab proteins secreted into the *E. coli* periplasm were extracted by osmotic shock for binding screens.

Primary Screen by ELISA:

The fab PPE extracts were tested for binding to the panning antigen hTIGIT-HIS or hTIGIT-hFc by ELISA. The positive hits from the ELISA screen were sequenced using heavy chain and light chain-specific primers. The sequences were assembled and analyzed. Clones were deemed sequence-unique if there were more than one non-conservative differences in heavy chain CDR3.

Secondary Screen by Flow Cytometry:

The sequence-unique ELISA-positive fab clones were selected and analyzed for their ability to bind human TIGIT over-expressing Expi293 cells by flow cytometry. Parental Expi293 cells were used as a negative control for each fab sample.

Re-Formatting of Fab Hits and Production as Human IgG4 Molecules:

Potential human TIGIT binding fabs were converted to full length human IgG4 (including a S241P hinge mutant, see Aalberse et al., Immunology 202 105:9-19, hereby incorporated by reference in its entirety, and in particular for the discussion of S241P and references 1, 2 and 3 cited therein) for further characterization. Protein expression constructs were derived by PCR-amplification of variable heavy and light chain sequences, which were sub-cloned into pUNO3 vector (Invivogen).

3. Results

Functional QC of the Human TIGIT Recombinant Proteins:

The hTIGIT-HIS and hTIGIT-hFc recombinant proteins, either generated in-house or sourced commercially, were functionally validated by their ability to bind to human PVR. Human PVR (Fc-conjugated) showed a dose-dependent binding to biotinylated hTIGIT-HIS in ELISA (data not shown). Similar binding was observed in the reverse orientation where PVR was immobilized on the ELISA plate and hTIGIT-HIS was in solution (data not shown).

The hTIGIT-hFc protein was functionally validated by binding to PVR in a flow cytometry assay. In this assay, the hTIGIT-hFc protein was titrated against Expi293 cells that endogenously express human PVR. The interaction was detected using an anti-hFc secondary antibody conjugated to AF647 fluorescence label. An irrelevant Fc protein was used as a control (data not shown).

Functional assays were done on a number of the candidates as is described in the Examples below.

Affinity Maturation Binding Screens Using Antibodies Expressed as Fab Fragments:

Eight 96-well plates of periplasmic extracted fab clones were analyzed for the de novo campaigns (1 and 2). Seventy-three unique clones were identified in campaign 1 using the hTIGIT-HIS protein as target antigen. Secondary screening of the 73 ELISA positive Bones by flow cytometry identified 21 positive for binding to human TIGIT over-expressing Expi293 cells. A similar screen for campaign 2 (hTIGIT-hFc as target antigen) yielded 37 ELISA-positive clones, 24 of which were also positive for binding to human TIGIT over-expressing Expi293 cells, by flow cytometry (FIG. 52).

Two 96-well plates of fab clones (as PPEs) were screened for the optimization/affinity maturation campaigns (3 and 4). The ELISA-positive unique variants were screened for binding to human and/or cynomolgus TIGIT over-expressing Expi293 cells in flow cytometry. The binding affinities of the top clones to the hTIGIT-HIS protein was also evaluated by Surface Plasmon Resonance (SPR). The first cycle of affinity maturation of CPA.9.002 antibody yielded 5 new antibodies, CPA.9.021, CPA.9.027, CPA.9.044, CPA.9.048, and CPA.9.049, with mutations in the L-CDR3 and at least 3-fold improvement in the binding affinity for recombinant human TIGIT. A second cycle of optimization of CPA.9.027 antibody yielded 4 new antibodies with at least 25-fold improvement in binding to recombinant human TIGIT. The new variants showed mutations in the H-CDR2 and L-CDR3 (CPA.9.083 and CPA.9.086) and additionally in the L-FR4 for CPA.9.089 and CPA.9.093. Optimization of CPA.9.059 resulted in two new antibodies, CPA.9.101 and CPA.9.103, with significantly improved binding to cynomolgus TIGIT as well as a significant improvement in the human TIGIT binding for CPA.9.103. The mutations were observed in H-CDR3 and L-CDR1 for both the new variants. Additionally, minor changes in L-FR1 were observed for CPA.9.101.

Reformatting of the ELISA and FACS Positive Fabs into hIgG4:

Forty-five unique fabs positive for ELISA and flow cytometry human TIGIT binding were reformatted for expression as human IgG4 molecules, inclusive of an optional S241P hinge variant as discussed herein. In addition, 11 affinity optimized variants were also reformatted as IgG4. The sequences of selected phage-derived antibodies are shown in FIG. 53. The sequences of two benchmark antibodies, BM26 (WO2016/028656, Clone 31C6) and BM29 (US2016/0176963, Clone 22G2) are also shown in FIG. 53 for comparison. The reformatted antibodies were evaluated for binding to human TIGIT over-expressing Expi293 cells and a binding curve was generated to calculate the equilibrium binding constant (KD). These antibodies were also evaluated for binding to cyno TIGIT over-expressing Expi293 cells as well as their ability to block the interaction between human TIGIT and human PVR in cell-based assays. Based on these characterization, a subset of these antibodies were selected for in vitro functional assays as more fully described below.

K. Example 11: TIGIT Therapeutic Antibody Discovery by Hybridoma

1. Rationale and Objectives

Hybridoma technology using known and standard methods in the field was used to generate murine antibodies that bind to human TIGIT with high affinity, are cross-reactive with non-human primate (cynomolgus macaque, *Macaca fascicularis*, referred to as cyno) TIGIT, and block the interaction of TIGIT with its ligand, PVR (CD155).

2. Summary

Balb/c mice were immunized with recombinant forms of human and cyno TIGIT extra-cellular domain proteins. Cells isolated from the spleen and lymph nodes of immunized mice were fused with the Sp2/0 myeloma cell line to generate hybridomas that secrete murine antibodies. Supernatants from polyclonal and sub-cloned monoclonal hybridomas were screened for binding to human and cyno TIGIT-overexpressing Expi293 cells and for binding affinity for human and cyno TIGIT recombinant proteins using standard SPR methods. Murine antibodies from selected hybridomas were purified and characterized extensively in binding and functional assays. Five functional and cyno cross-reactive murine antibodies were humanized to contain a hIgG4 framework (inclusive of an optional hinge variant as outlined herein) and isotype. The sequences are shown in FIG. 53.

L. Example 12: FACS KD Measurements of Phage and Hybridoma-Derived Antibodies Binding to Cells Over-Expressing Human and Cyno TIGIT 1. Protocols The following cell lines were prepared to estimate the binding affinities of human phage and mouse anti-TIGIT antibodies: Expi293 Parental, Expi293 human TIGIT over-expressing, and Expi293 cyno TIGIT over-expressing. The following hybridoma and phage antibodies were each prepared in an 11-point 2-fold serial dilution series at a binding site concentration range of 195 pM-200 nM:

Phage generated antibodies: CPA.9.027, CPA.9.049, CPA.9.059.

Hybridoma generated antibodies (pre-humanization): CHA.9.536, CHA.9.541, CHA.9.543, CHA.9.546, CHA.9.547 and CHA.9.560. Included were two different benchmark antibodies, BM26 (WO2016/028656A1, Clone 31C6 as mouse IgG1) and BM29 (US2016/0176963A1, Clone 22G2 as mouse IgG1).

The 12th well of each titration contained buffer only to serve as background. Each cell type was incubated with an anti-human TIGIT mAb for 60 minutes at 4° C. After washing, AF647-tagged goat anti-human F(ab') (Jackson Immunoresearch) and AF647-tagged goat anti-mouse IgG-Fc (Southern Biotech #1030-30) were added to cells incubated with human and mouse mAbs, respectively. A FACS Canto II HTS instrument then recorded the Geometric Mean Fluorescence Intensity (gMFI) of 5000-10,000 events for each well. A plot of the gMFI as a function of the human PVR molecular concentration was fit using Graphpad Prism's "one site, specific binding" model to estimate the KD and the 95% confidence intervals of each nonlinear fit.

2. Results

The two independent FACS KDs measured for each mAb differed by no more than 2-fold on average. A single representative measurement for KD along with the 95% confidence interval of the binding isotherm fit is listed for each mAb for human and cyno over-expressing cells in FIG. 54 and FIG. 55, respectively. CPA.9.059 did not show binding to the cyno over-expressing cells. It should be noted that the binding site concentrations (2× the molecular concentration) for all mAbs are used for the nonlinear curve-fitting, which means the assumption is made that this FACS KD method is measuring the binding site constant (kD) rather than the molecular or stoichiometric binding constant.

M. Example 13: FACS Blocking Assay of Phage and Hybridoma-Derived Anti-Human TIGIT mAbs Inhibiting PVR-FC Binding to TIGIT 1. Introduction The purpose of this assay is to characterize phage and hybridoma-derived anti-human TIGIT antibodies' ability to inhibit the binding of human PVR to human TIGIT over-expressed on a cell surface. First, the human TIGIT-human PVR binding affinity will be determined by FACS. The binding isotherms showed the saturating concentration of human PVR which was used for the blocking assays. Next, cells over-expressing human TIGIT cells were titrated with phage and hybridoma-produced anti-TIGIT mAbs, followed by adding a saturating concentration of human PVR. Anti-human TIGIT antibody binding on the over-expressing cells were then measured using FACS.

2. Protocols

FACS KD Assay:

Various human PVR-Fc isotypes were tested via FACS for optimal binding and it was determined human PVR-h1Fc (Sino Biological #10109-H20H) and human PVR-m2aFc (Compugen) showed the highest binding levels to human TIGIT over-expressing cells. The two PVR isotypes were each 2-fold serially diluted over an 11-point titration series at a final molecular concentration range of 98 pM-100 nM. The 12th well of each titration contained buffer only to serve as background. Each cell type was incubated with mAb for 60 minutes at 4° C. while. After washing, AF647-tagged F(ab')2 fragment goat-anti human Fc (Jackson Immunoresearch #109-606-098) and AF647-tagged goat anti-mouse IgG (SouthernBiotech #1033-31) were added to wells titrated with human and mouse anti-TIGIT mAbs, respectively. A FACS Canto II HTS instrument then recorded the Geometric Mean Fluorescence Intensity (gMFI) of 5000-10,000 events for each well. A plot of the gMFI as a function of the human PVR molecular concentration was fit using Graphpad Prism's "one site, specific binding" model to estimate the KD and the 95% confidence intervals of each nonlinear fit. Results of human PVR-m2aFc and human PVR-h1Fc are shown in FIGS. 57A and B, respectively.

Phage MAbs Blocking Assay:

The following phage-derived hIgG4 antibodies and benchmark mAbs were each prepared in a three-point 5-fold serial dilution series at a binding site concentration range of 267 pM-6.7 nM: CPA.9.027, CPA.9.049 and CPA.9.059, as well as BM26 (WO2016/028656A1, Clone 31C6 as hIgG4) and Synagis hIgG4 (negative isotype control).

The 4th well of each titration contained buffer only to serve as a background. Cells were incubated with mAb for 15 minutes at 4° C. Human PVR-m2aFc (Compugen) was then incubated for 1 hour at 4° C. After washing, AF647-tagged goat anti-mouse IgG (SouthernBiotech #1033-31) was added. A FACS Canto II HTS instrument then recorded the Geometric Mean Fluorescence Intensity (gMFI) of 5000-10,000 events for each well. The gMFI values of bound human PVR for the cells pre-incubated with the mAbs were compared to gMFI values of cells pre-incubated with the blocking benchmark mAb and non-blocking control mAb. If a phage antibody reduced the human PVR-m2aFc binding signal compared to the signal from the titration with the known non-blocking mAb, the antibody was characterized as blocking PVR binding at that concentration of phage mAb. The blocking trends of the phage mAbs were similar to the PVR blocking with the BM26 benchmark (FIG. 58).

Hybridoma MAbs Blocking Assay:

The following hybridoma antibodies were each prepared in an 11-point 2.5-fold dilution series at a binding site concentration range of 14 pM-133 nM: CHA.9.536, CHA.9.541, CHA.9.546, CHA.9.547, CHA.9.560, BM26 (WO2016/028656A1, Clone 31C6 as mouse IgG1) and BM29 (US2016/0176963A1, Clone 22G2 as mouse IgG1).

The 12th well of each titration contained buffer only to serve as background. Cells were incubated with mAb for 15 minutes at 4° C. Human PVR-h1Fc (Sino Biological #10109-H20H) was then added, and the cells were then incubated for 1 hour at 4° C. After washing, AF647-tagged F(ab')2 fragment goat-anti human Fc (Jackson Immunoresearch) was added. A FACS Canto II HTS instrument then recorded the Geometric Mean Fluorescence Intensity (gMFI) of 5000-10,000 events for each well. A plot of the gMFI as a function of the mAb binding site concentration was fit nonlinearly using Graphpad Prism's "log(inhibitor) vs. response—Variable slope (four parameters)" model to estimate the IC50 of each nonlinear fit. This experiment was repeated twice over two days.

3. Results

FIGS. 58 and 59 Demonstrate that Both the Phage and Hybridoma Antibodies Potently Block the Binding of Human PVR-Fc to Human TIGIT Over-Expressed on the Cell-Surface of Expi293 Cells.

The blocking activity of the phage and hybridoma antibodies is comparable to the two benchmark antibodies tested, BM26 and BM29.

N. Example 14: Surface Plasmon Resonance (SPR) Kinetics Studies of Nine Phage- and Hybridoma-Derived mAbs Binding to Human, Cyno, and Mouse TIGIT 1. Protocols All experiments were performed using a ProteOn XPR 36 instrument at 22° C. First, high density capture surfaces were prepared with goat anti human Fc polydonal antibody (Thermo #H10500) and rabbit anti mouse antibodies (GE Healthcare #BR100838), respectively, immobilized over all vertical capture lanes and horizontal interspots on separate GLC chips using standard amine coupling. Typical immobilization levels for the anti-human capture pAb and the anti-mouse capture antibody for each GLC chip were around 5000 RU. Human TIGIT was obtained from Sino Biologicals while mouse TIGIT monomer and cyno TIGIT monomer were prepared in-house. The purified mAbs studied for binding to human, mouse, and cyno TIGIT are listed below:

Phage antibodies: CPA.9.027, CPA.9.049 and CPA.9.059
Hybridoma antibodies: CHA.9.536, CHA.9.541, CHA.9.543, CHA.9.546, CHA.9.547 and CHA.9.560
Benchmark comparisons: BM26 (WO2016/028656A1, Clone 31C6 as hIgG4) and BM29 (US2016/0176963A1, Clone 22G2 as hIgG4).

Each mAb was diluted to ~0.5 μg/mL in running buffer which was 1×PBST with filtered BSA added to a final concentration of 100 μg/mL. For each "single-shot kinetics" cycle on the ProteOn instrument, a different mAb was captured over one of the six unique vertical capture lanes for approximately 1.5-2.5 minutes. After switching the buffer flow of the ProteOn to the horizontal direction, capture surfaces were stabilized for approximately 15-20 minutes. Six concentrations of a 3-fold dilution series of human TIGIT (346 pM-84.1 nM), cyno TIGIT (371 pM-90.2 nM), or mouse TIGIT (382 pM-92.9 nM) were injected for 2 minutes followed by 20 minutes of dissociation at a flow rate of 50 μL/min. An identical buffer injection preceded each series of injected antigen for double-referencing. Anti-human antibody surfaces were regenerated with two 30-second pulses of 146 mM phosphoric acid and anti-mouse antibody capture surfaces were regenerated with two 30-second pulses of 10 mM glycine, pH 1.7. The sensorgrams of TIGIT antigen injected over captured mAbs were processed using a ProteOn version of Scrubber and were fit to a 1:1 kinetic binding model including a term for mass transport.

FIG. 56 shows the resulting kinetic rate constants and the equilibrium dissociation constants where data were reliable enough to estimate the binding constants (sensogram data not shown). The asterisks indicate the kd values that had to be held constant at $1.00 \times 10-5$/sec. In cases such as done CHA.9.560 binding to human TIGIT, the kinetic model was able to estimate a Kd, but it is it virtually impossible to accurately estimate a Kd on the order $1 \times 10^{-6}$/sec after only 20 minutes of dissociation data given the sensitivity of the instrumentation.

O. Example 15: Functional Analyses of Anti-TIGIT Antibodies

1. Rationale and Objectives

To functionally characterize the ability of anti-human TIGIT antibodies to inhibit the interaction of TIGIT and its ligand PVR, and to consequently enhance human T cell activation either as a monotherapy or in combination with an anti-human PVRIG antibody, CHA.7.518.1.H4(S241P).

2. Protocols

Human TIGIT/CD155 Jurkat IL-2 Luciferase Reporter Assay:

The human TIGIT/PVR Jurkat IL-2 luciferase reporter bioassay kit (Promega) was utilized to assess the effect of anti-human TIGIT antibody treatment on T cell activation. Jurkat T cells were stably transfected with recombinant human TIGIT and a luciferase reporter gene driven by the IL-2 response element (IL-2-RE). The stimulator cells were artificial APC (aAPC) CHO-K1 cells expressing recombinant human PVR, and an engineered cell surface protein designed to activate TCR-mediated signaling in an antigen-independent manner. Following co-culture of these cells, the human TIGIT/human PVR interaction inhibits TCR signaling and IL-2-RE-mediated luminescence. Addition of an anti-human TIGIT antibody that blocks the human TIGIT/ human PVR interaction releases the inhibitory signal, resulting in T cell activation and IL-2-RE-mediated luminescence. The assay was carried out according to the manufacturer's instructions. Briefly, aAPC CHO-K1 human PVR cells were thawed in a 37° C. water bath and diluted in F-12 medium supplemented with 10% FBS (Promega). 25,000 cells/well were plated on white, flat-bottom tissue culture treated 96 well plates (Costar). Plates were then incubated overnight at 37° C. The next day, hybridoma and phage-derived anti-human TIGIT antibodies, mouse IgG1 (mIgG1) and hIgG4 isotype control antibodies, or benchmark (BM) anti-human TIGIT antibodies were added either as a single dose at 10 μg/ml, or in a 10 point, 2-fold dilution series starting at 20 μg/ml. Jurkat IL-2-RE luciferase human TIGIT cells were thawed in a 37° C. water bath and diluted in RPMI medium supplemented with 10% FBS (Promega). 125,000 Jurkat cells were added to each well. Plates were then incubated at 37° C. with 5% CO2 for 6 hours. After the incubation, plates were removed from the incubator and allowed to equilibrate to room temperature for 30 minutes. 80 μl of Bio-Glo luciferase substrate (Promega) was added to each well and the mixture was allowed to equilibrate for 10 minutes at room temperature protected from light. Luminesce was quantified on an EnVision multi-label reader (Perkin Elmer) with an ultra-sensitive luminescence detector. Luminesce signal was reported in relative light units (RLU).

Human CMV-Specific CD8+ T Cell Expansion:

Human CMV-reactive peripheral blood mononuclear cells (PBMCs) (CTL) were thawed, resuspended at $2 \times 10^6$ cells/ml, and stimulated with 1 μg/ml of the CMV pp65 peptide (Anaspec) in complete RPMI medium supplemented with 2 ng/ml recombinant human IL-2 (R&D systems) and 10 ng/ml recombinant human IL-7 (R&D systems) at 37° C. with. After 9 days, cells were split 1:2 and rested with low dose human IL-2 (100 IU/ml). The frequency of CMV-specific CD8+ T cells was determined with the CMV pp65/ HLA-A2 tetramer (MBL). CMV-specific CD8+ T cells that were 65-98% tetramer positive were utilized in assays between days 12 and 16 following CMV peptide stimulation.

Human CMV-Specific CD8+ T Cell Co-Culture Assay with Human PVR-Expressing Melanoma Cell Lines:

An in vitro co-culture assay with human CMV-specific CD8+ T cells was utilized to assess the effect of anti-human TIGIT antibodies on antigen-specific cytokine secretion. The target cell line used in the assay was the HLA-A2+ melanoma cell line, Mel624 stably transduced with a lentivirus containing human PVR DNA (System Biosciences). A stable pool of Mel624 human PVR over-expressing cells were pulsed with the CMV pp65 peptide at 0.0033 μg/ml or 0.001 μg/ml at 37° C. for 1 hour. Cells were then washed and plated at 50,000 cells/well. Hybridoma and phage derived anti-human TIGIT antibodies, control mIgG1 or hIgG4 isotype antibodies, or BM anti-human TIGIT antibodies were added at a concentration of 10 μg/ml. Human CMV-specific CD8+ T cells from three different donors, specified as Donor 2, Donor 4, and Donor 210 were expanded according to the protocol above. 50,000 human CD8+ T cells were added to each well. Co-cultures were incubated at 37° C. with 5% CO2 for 24 hours. After the incubation, plates were centrifuged at 1200 rpm for 1 minute and the supernatant was collected. The amount of human interferon gamma (IFNγ) in the co-culture supernatant was measured by flow cytometry using a cytometric bead assay (BD).

Human CMV-Specific CD8+ T Cell Co-Culture Assay with Human PVR- and Human PVRL2 (CD112)-Expressing Melanoma Cell Lines:

The combined effect of anti-human TIGIT antibodies and CHA.7.518.1.H4(S241P), an anti-human PVRIG antibody, on antigen-specific cytokine secretion was assessed by an in vitro co-culture assay with human CMV-specific CD8+ T cells similar to the assay described above. The target cell line used in the assay was the HLA-A2+ melanoma cell line, Mel624, which stably expressed human PVR and human PVRL2, the ligands for TIGIT and PVRIG, respectively, through lentiviral transduction (System Biosciences). The human PVR and human PVRL2 overexpressing Mel624 cells were pulsed with the CMV pp65 peptide at 0.0033 μg/ml or 0.001 μg/ml at 37° C. for 1 hour. Cells were then washed and plated at 50,000 cells/well. Hybridoma and phage derived anti-human TIGIT antibodies, or a BM anti-human TIGIT antibody, were added to the culture in combination with CHA.7.518.1.H4(S241P) or a control hIgG4 isotype antibody at 10 μg/ml. Human CMV-specific CD8+ T cells from three different donors, specified as Donor 4, Donor 25, and Donor 210 were expanded, according to the protocol above. 50,000 human CD8+ T cells were added to each well. Co-cultures were incubated at 37° C. for 24 hours. After the incubation, plates were centrifuged at 1200 rpm for 1 minute and the supernatant was collected. The amount of human interferon gamma (IFNγ) in the co-culture supernatant was measured by flow cytometry using a cytometric bead assay (BD).

3. Results

Anti-Human TIGIT Antibodies Enhance IL-2 Signaling:

The ability of hybridoma and phage-derived anti-human TIGIT antibodies to enhance IL-2 signaling was assessed with the human TIGIT/human PVR Jurkat luciferase reporter assay. FIG. 60 and FIG. 62 demonstrate the effect of 10 μg/ml phage or hybridoma-derived anti-human TIGIT antibodies on IL-2 signaling, respectively. Three phage-derived antibodies, CPA.9.027, CPA.9.049, and CPA.9.059 robustly enhanced IL-2 signaling compared to the hIgG4 isotype control. In addition, all three phage antibodies induced more IL-2 signaling compared to the BM anti-human TIGIT antibodies, BM26 and BM29. The five hybridoma-derived antibodies, CHA.9.536, CHA.9.541, CHA.9.546, CHA.9.547 and CHA.9.560 also induced IL-2 signaling compared to the mIgG1 isotype control. Of note, the five hybridoma antibodies induced similar IL-2 signaling compared to BM26 and BM29. The anti-human TIGIT non-blocking antibody, CHA.9.543 did not significantly increase IL-2 signaling. To determine whether the effect of anti-TIGIT antibodies was dose-dependent, the assay was carried out with a 10 point, 2-fold dilution series for each antibody starting at 20 µg/ml (FIGS. 61 and 63). IL-2 signaling decreased in a dose-dependent manner with all eight anti-human TIGIT antibodies, as well as BM26 and BM29.

Anti-Human TIGIT Antibodies Increase IFNγ Secretion from Human CMV-Specific CD8+ T Cells:

The ability of hybridoma and phage-derived anti-human TIGIT antibodies to modulate IFNγ secretion was assessed with the CMV-specific T cell/Mel624 co-culture assay. FIG. 64 shows the effect of the anti-human TIGIT antibodies on IFNγ secretion. Three phage-derived antibodies, CPA.9.027, CPA.9.049, and CPA.9.059 enhanced IFNγ secretion compared to the media alone and hIgG4 isotype control antibody. Additionally, five hybridoma derived antibodies, CHA.9.536, CHA.9.541, CHA.9.546, CHA.9.547 and CHA.9.560 also increased IFNγ production compared to the mIgG1 isotype control antibody. The phage and hybridoma-derived TIGIT antibodies induced IFNγ in a similar manner to BM26 and BM29. As expected, the anti-human TIGIT non-blocking antibody, CHA.9.543 did not significantly effect IFNγ secretion.

FIG. 65 shows the combined effect of the anti-human TIGIT antibodies and CHA.7.518.1.H4(S241P) on IFNγ secretion. Three phage-derived antibodies, CPA.9.027, CPA.9.049, and CPA.9.059, and five hybridoma derived antibodies, CHA.9.536, CHA.9.541, CHA.9.546, CHA.9.547 and CHA.9.560, including BM26, all enhanced IFNγ secretion compared to their respective isotype control antibodies, when either treated alone, or in combination with CHA.7.518.1.H4(S241P). The anti-human TIGIT non-blocking antibody, CHA.9.543 resulted in less IFNγ secretion compared to other anti-human TIGIT antibodies. The percent increase of IFNγ secretion in each antibody over respective isotype control antibodies is summarized in FIG. 66. A synergistic effect is observed in the combined treatment of anti-human TIGIT antibodies and CHA.7.518.1.H4 (S241P).

4. Summary and Conclusions

Addition of anti-human TIGIT antibodies to the human TIGIT/human PVR Jurkat reporter assay induced a robust, dose-dependent increase in IL-2 signaling. Additionally, the anti-human TIGIT antibodies increased IFNγ secretion from human CMV-specific CD8+ T cells when co-cultured with Mel624 human PVR cells. The secretion of IFNγ was further increased by anti-human TIGIT antibodies in combination with an anti-human PVRIG antibody. Taken together, these data demonstrate that the anti-human TIGIT antibodies can block TIGIT-mediated suppression of human T cell activation, and T cell activation is enhanced by co-blockade of both TIGIT and PVRIG.

P. Example 16: Binning Analysis of Anti-TIGIT Antibodies

1. Protocols

Experiments were performed by Wasatch Microfluidics Inc. (Salt Lake City, Utah) using a Continuous Flow Microspotter (CFM) and an IBIS MX96 SPR Imager (MX96 SPRi). The following anti-human TIGIT mAbs and human PVR-Fc variants were each diluted to ~10 µg/mL in 10 mM sodium acetate, pH 5.0 and covalently immobilized using standard amine coupling on independent spots of a Xantec 200M biosensor prism chip for 7-minute cycles using the CFM:

| | |
|---|---|
| 1 | CPA.9.009-H4 |
| 2 | CPA.9.011-H4 |
| 3 | CPA.9.012-H4 |
| 4 | CPA.9.013-H4 |
| 5 | CPA.9.014-H4 |
| 6 | CPA.9.015-H4 |
| 7 | CPA.9.018-H4 |
| 8 | CPA.9.027-H4 |
| 9 | CPA.9.049-H4 |
| 10 | CPA.9.053-H4 |
| 11 | CPA.9.057-H4 |
| 12 | CPA.9.059-H4 |
| 13 | CPA.9.064-H4 |
| 14 | CPA.9.069-H4 |
| 15 | CPA.9.071-H4 |
| 16 | CPA.9.077-H4 |
| 17 | CPA.9.081-H4 |
| 18 | CHA.9.519 |
| 19 | CHA.9.521 |
| 20 | CHA.9.522 |
| 21 | CHA.9.527 |
| 22 | CHA.9.528 |
| 23 | CHA.9.529 |
| 24 | CHA.9.535 |
| 25 | CHA.9.536 |
| 26 | CHA.9.541 |
| 27 | CHA.9.546 |
| 28 | CHA.9.547 |
| 29 | CHA.9.549 |
| 30 | CHA.9.552 |
| 31 | CHA.9.554 |
| 32 | CHA.9.555 |
| 33 | CHA.9.560 |
| 34 | CHA.9.525 |
| 35 | CHA.9.538 |
| 36 | CHA.9.543 |
| 37 | CHA.9.553 |
| 38 | CHA.9.556 |
| 39 | CHA.9.561 |
| 40 | BM8-H4 |
| 41 | BM9-H4 |
| 42 | BM26-H4 |
| 43 | BM29-H4 |
| 44 | MBSA43-M1 |
| 45 | PVR-Fc M2A |
| 46 | Sino PVR-Fc |

BM8-H4 and BM9-H4 refer to (US2015/0216970A1, Clones 10A7 and 1F4 reformatted as hIgG4), respectively. MBSA43-M1 is a mouse anti-human TIGIT IgG1 from eBioscience. The prism chip was then rinsed with 1×PBST for 3 minutes and then directly loaded into the MX96 SPRi imager where excess NHS esters were quenched with a 5-minute injection of 1 M ethanolamine. Preliminary experiments included several cycles of injecting 100 nM monomeric human TIGIT (Sino Biologicals, Cat #10917-H08H) over all immobilized mAbs for four minutes followed by regeneration in order to test the binding activity of the antibodies and to best determine the regeneration conditions by assessing reproducibility of the TIGIT binding. These preliminary experiments showed that the best reagent to reproducibly regenerate most of the immobilized mAbs was a 30-second pulse of 1/500 phosphoric acid. The immobilized PVR, however, did not retain activity and therefore their blocking patterns were generated and "binned" as analytes in solution only. In these preliminary experiments and the binning experiments described below, all protein samples were prepared in the running buffer which was degassed HBST. A "sandwich" epitope binning protocol was performed where each mAb and PVR was injected over TIGIT pre-complexed to each immobilized mAb to determine whether or not the immobilized mAb blocks the mAb in solution from binding to TIGIT. For each cycle 100 nM of TIGIT was first injected over all immobilized mAbs for 4 minutes followed immediately by a 4-minute injection of a competitor mAb or ligand at 274 nM (binding site concentration). This was repeated with each mAb and PVR acting as the competitor analyte. Control cycles with running buffer instead of competitor protein were performed after every 12 cycles for double-referencing. All surfaces were regenerated after each cycle with a 30 second pulse of 1/500 phosphoric acid. Sensorgram data were processed and referenced using Wasatch's proprietary software. An antibody pair was classified as having a shared TIGIT-binding epitope if no binding was observed from the injection of competitor over TIGIT pre-complexed to immobilized mAb. An antibody pair was classified as binding to different epitopes on TIGIT, or "sandwiching", if the injection of competitor mAb showed binding to the pre-complexed TIGIT. Low or minimal binding of competitor was classified as an "intermediate" blocker. Hierarchical clustering of the pair-wise TIGIT blocking patterns for each mAb and ligand was performed using Wasatch's proprietary software.

2. Results

Both PVR-Fc proteins and 13 of the mAbs either lost activity or could not be regenerated as ligands so their blocking patterns were determined as analytes in solution only. MAb CPA.9.014-H4 was not binned because it showed no binding to TIGIT. FIG. 67 shows the dendrogram clustering based on the pair-wise blocking patterns for each mAb and two PVR proteins. The vertical axis represents the statistical similarity factor in the blocking patterns. Wasatch Microfluidics applied a cut-off factor of 5 to cluster the mAbs which is indicated by the line in FIG. 67. For the strictest definition of an epitope "bin" where only those mAbs (and PVRs) which show identical blocking patterns bin together, there are a total of 12 discrete bins. If blocking patterns that show only minimal differences are clustered together, there are four closely related "communities" of mAbs and PVRs. These "communities" are indicated with different shaded blocks on the bottom of FIG. 67. FIG. 68 groups together the mAbs and PVRs that populate each discrete, unique bin with each bin indicated by a black box. Gray boxes surround all the unique bins that make up each "community" of related blocking patterns. The mAbs and PVRs in FIG. 68 are listed with the number key which represents each protein in the dendrogram in FIG. 67.

Q. Example 17: Administration of Anti-PVRIG Antibodies to TIGIT Knock Out Mice

Rationale and Objectives

To examine whether TIGIT deletion in combination with mouse PVRIG blockade can enhance tumor growth inhibition and survival in a syngeneic mouse tumor model.

Protocols

Animals

TIGIT knockout (KO) mice were generated at Ozgene Pty LTD (Australia). C57BL/6 wild type (WT) mice (Ozgene) served as controls. Eight to eleven weeks old female TIGIT KO and C57BL/6 mice were used. All studies were approved by the Institutional Animal Care and Use Committee at the Tel-Aviv University (Tel-Aviv, Israel).

In Vivo Tumor Models $1 \times 10^5$ B16/Db-hmgp100 melanoma cells were inoculated subcutaneously (s.c.) into the right flank of C57BL/6 WT or TIGIT KO mice. Antibody treatment was initiated on the same day as tumor inoculation (day 0), with 7-10 mice per treatment group. Antibodies used were the mouse IgG1 isotype control (Clone MOPC-21 BioXcell), and mouse IgG1 anti-mouse PVRIG (Clone 407, Compugen LTD). Antibodies were administered at 10 mg/kg by intra-peritoneal injection, twice per week for 3 weeks. Tumor growth was measured with electronic caliper every 2-3 days and was reported as $0.5 \times W^2 \times L$ mm3 (L is length and W is width of the tumor). Animals reaching 2250 mm3 tumor size were anesthetized.

Statistical Analysis

Two-way ANOVA with repeated measures, followed by two-way ANOVA with repeated measures for selected pairs of groups was performed using JUMP software (Statistical Discoveries™). Analyses of tumor growth measurements were performed by comparing tumor volumes measured on the last day on which all study animals were alive. Statistical differences in percentage of mice tumor free were determined by a Log Rank Mantel-Cox test. Values of $P<0.05$ were considered significant. * $p<0.05$;  $p<0.01$; * $p<0.001$.

Results

In Vivo Tumor Growth Inhibition Following Treatment with Anti-Mouse PVRIG Blocking Antibody in TIGIT KO Mice We tested the in vivo efficacy of TIGIT deletion in combination with mouse PVRIG blockade in a syngeneic mouse B16/Db-hmgp100 subcutaneous melanoma tumor model. Treating tumor bearing C57BL/6 WT mice with an anti-mouse PVRIG blocking antibody had a minor effect on tumor growth inhibition (TGI) compared to the isotype treatment (17% TGI at day 11 and 8% TGI at endpoint, day 18). The effect of TIGIT deletion on tumor growth was minor compared to C57BL/6 WT control group (17% TGI at day 11 and 13% TGI at endpoint). However, when TIGIT deletion was combined with anti-mouse PVRIG antibody (Clone 407) treatment, significant TGI was evident (63% at day 11 and 49% TGI at endpoint) (FIGS. 80A and 80B). In accordance to TGI, TIGIT KO mice treated with the anti-mouse PVRIG antibody (Clone 407) exhibited increased survival compared to the C57BL/6 WT control group, however, statistical significance was not achieved (FIG. 80C).

Summary and Conclusions

The combination of TIGIT deletion and PVRIG blockade significantly reduced tumor growth in vivo, indicating that both TIGIT and PVRIG play an inhibitory role in this melanoma tumor model. These data suggest that co-targeting TIGIT and PVRIG could be another combination therapy that significantly enhances anti-tumor responses.

R. Example 18: PVRIG Antagonism Enhances T Cell Effector Function and Reduces Tumor Growth Abstract Despite recent advances, the majority of patients do not derive long term benefit from checkpoint inhibitors. PVRIG is a novel immune suppressive receptor of the DNAM/

TIGIT family and we demonstrate here a role of PVRIG in regulating anti-tumor responses. PVRIG binds to PVRL2 and displays significantly enhanced expression on tumor infiltrating lymphocytes as compared to lymphocytes from normal tissues. PVRIG antagonism enhanced human T cell activation and combination of PVRIG with either PD-1 or TIGIT inhibitors further synergistically increased lymphocyte function. We next addressed the role of PVRIG in preclinical tumor models. PVRIG$^{-/-}$ mice displayed significantly increased T cell activation in vitro and reduced MC38 tumor growth that was mediated by increased CD8 effector function. Antagonistic anti-PVRIG antibody significantly reduced tumor growth in combination with anti-PD-L1 or when tested in TIGIT$^{-/-}$ mice. In summary, we demonstrate that PVRIG-PVRL2 pathway was induced in human cancers and that antagonizing PVRIG-PVRL2 interactions resulted in increased T cell function and reduced tumor growth.

State of Significance

These data demonstrate that PVRIG is a promising target for the treatment of cancer and provide the rationale for testing a PVRIG inhibitor, CHA.7.518.1.H4(S241P), as a novel cancer immunotherapy agent either as monotherapy or in combination with either TIGIT or PD1 blockade.

Introduction

Increasing evidence demonstrate that endogenous immune responses are critical in sculpting the initiation, progression, and suppression of cancer (1) (2). The immune status of patients as well as the content of tumor-infiltrating leukocytes (TILs) within the tumor microenvironment (TME) are key prognostic indicators of not only cancer survival rates, but also how patients respond to therapy (3) (4). T cells are a key component of TILs that can invoke an anti-tumor response, and most anti-tumor immune responses ultimately rely on the functionality of effector lymphocytes cells. An enrichment of CD8 T cells in the TME of a patient's tumor, as well as other factors that bias an immune response towards an effective CD8 T cell response such as mutational load and a Th1 polarized TME, are all key prognostic indicators for a favorable anti-tumor immune response (5) (6).

A key observation across many solid tumors is that effector T cells have an activated or 'exhausted' phenotype within the TME (7). This indicates that although T cells within the TME have initially seen cognate antigen, been activated, and trafficked to the tumor, they are subsequently not capable of invoking an effective anti-tumor response. Pre-activated or exhausted T cells are defined by increased surface expression of co-inhibitory receptors, such as PD-1 and CTLA-4 (8). Therapeutically targeting these co-inhibitory receptors with antibodies that inhibit interactions with their cognate ligands have shown remarkable clinical efficacy in patients with multiple advanced cancers (9). Mechanistically, it has been shown that targeting these co-inhibitory receptors leads to the expansion of already tumor-reactive T cells that pre-exist in the TME and to the production of T cell pools with widened T cell receptor diversity (10) (11) (12). Although checkpoint inhibitors currently in the clinic have revolutionized cancer treatment and demonstrated the power of the immune system in combating cancer, many patients still relapse and/or do not respond to treatment. Consequently, increased understanding of the immune response in cancer and targeting additional immune-based pathways will lead to additional therapeutic treatments.

Among these novel pathways, a group of receptors and ligands within the nectin and nectin-like family are currently under investigation as potential novel cancer immunotherapies. Receptors within this family include DNAM-1 (CD226), CD96 (TACTILE), TIGIT, and more recently, PVRIG (CD112R) (13) (14) (15). Of these molecules, DNAM is an activating receptor within this subfamily, binding to 2 ligands, PVR (CD155) and PVRL2 (CD112), to deliver an activating signal to lymphocytes (16). Two receptors in this family have been shown to inhibit human lymphocyte function, TIGIT, and more recently, PVRIG (17) (18). TIGIT is reported to have a high affinity interaction with PVR, a much weaker affinity to PVRL2, and has been shown to inhibit both T cell and NK cell responses by delivering an inhibitory signal into lymphocytes through its ITSM motif (19) (20). More recently, PVRIG was shown to bind with high affinity to PVRL2 and to deliver an inhibitory signal through its ITIM motif (15). In both cases, the affinity of TIGIT to PVR and of PVRIG to PVRL2 is higher than the affinity of DNAM to either PVR or PVRL2, suggesting TIGIT and PVRIG can outcompete PVR and PVRL2 from DNAM, providing an indirect mechanism by which TIGIT and PVRIG can reduce T cell function. Within this family, PVR is also a ligand for CD96. The function of CD96 has been reported to be inhibitory on mouse lymphocytes (21) but activating on human lymphocytes (22). Based on these data, we postulate on human lymphocytes that 2 receptors, TIGIT and PVRIG, bind with high affinity to PVR and PVRL2, respectively, to deliver inhibitory signals to dampen T cell function.

Although human PVRIG has been shown to inhibit T cells response in one recent report, the role of PVRIG and PVRL2 in cancer immune surveillance is not well understood. In particular, the expression profile of this pathway in cancers and the role of PVRIG in regulating CD8 T cell anti-tumor responses has not been reported. Furthermore, functional characterization of the mouse PVRIG gene and the effect of disrupting PVRIG-PVRL2 interaction in vivo in pre-clinical tumor models has not been reported. Herein, we elucidated the role of PVRIG in a cancer setting by reporting on PVRIG and PVRL2 expression profile in cancer and the effect of PVRIG antagonism in tumor cell co-culture assays and in preclinical tumor models. We demonstrate that PVRIG has a differentiated expression profile on T cell subsets compared to TIGIT or CD96 and that PVRIG and PVRL2 expression were induced in cancer compared to normal adjacent tissues. In multiple human in vitro assay systems, a high-affinity PVRIG antagonistic monoclonal antibody (CHA.7.518.1.H4(S241P)) enhanced T cell function, in particular when combined with anti-TIGIT or anti-PD1 antibody. In addition, we report the novel characterization of mouse PVRIG using antagonistic antibodies or PVRIG deficient mice and demonstrate that inhibition of PVRIG-PVRL2 interaction reduced tumor growth, with most potent effects in combination with PD-1 inhibition or TIGIT genetic deficiency. Collectively, this data shows that PVRIG is a critical inhibitory receptor in regulating T cell anti-tumor responses and support the development of CHA.7.518.1.H4 (S241P), for clinical testing in cancer patients.

Materials and Methods

Human Peripheral Blood and Tumor Expression Studies

Healthy donor human PBMCs were obtained from Stanford University in accordance with the Declaration of Helsinki. Human tissues were provided by the Cooperative Human Tissue Network, a National Cancer Institute supported resource. Human cancer tissue and matched normal adjacent tissues were dissociated into single cells as per manufacturer's protocol (Miltenyi Biotec). Dissociated cells were analyzed by flow cytometry for expression of various targets on different cell subsets. For each target expression on an individual cell subset, a fold expression value was calculated by taking the MFI value of target divided by the MFI value of the isotype control. Other investigators may have received samples from these same tissue specimens. The tumor type was determined based on reviewing the pathology report for each sample. For IHC studies, anti-PVRL2 antibody (HPA-012759, Sigma) and PD-L1 (Sp142, SpringBio) were used to stain tumor micro-arrays (Biochain institute) using conditions as described in the supplemental methods. Scoring was performed by 2 independent reviewers on duplicate cores from the same tumor.

PVRIG Antibody Generation and Characterization

Anti-human PVRIG and anti-mouse PVRIG antibodies were generated as detailed in the supplemental methods. Briefly, antibody binding specificity and affinity were assessed by selective binding to PVRIG engineered cells with no detectable binding to cells that do no express the gene. Antagonistic activity of these anti-PVRIG antibodies was determined using ELISA and FACS based assays in which the interaction of PVRIG with PVRL2 was disrupted. For characterization in cell based assays, antibodies were tested in several T cell-target cell co-culture assay systems consisting of target cells that express PVRL2 in culture with PBMC or tumor-derived T cells. gp100 specific T cells lines were expanded from melanoma tumors as previously described (23). CMVpp65 reactive T cells were expanded from healthy donor PBMCs (CTL immunospot) with CMVpp65 (495-503), IL-2, and IL-7 for 10 days. For combination studies, antibodies to PD-1, TIGIT, and PVRIG were used at 10 μg/ml. Cytokine concentrations in conditioned media was determined using Cytometric Bead Array (CBA) and FACS staining was performed as described in the supplemental methods.

Characterization of Mouse PVRIG Expression and Function

Binding interactions of mouse PVRIG with mPVRL2 and mPVR were assessed by SPR and ELISA using recombinant PVRIG, PVRL2, and PVR proteins and by FACS using ectopically engineered PVRIG and PVRL2 overexpressing cell lines or PVR or PVRL2 siRNA transfected cell lines. PVRIG and TIGIT deficient mice were generated as described in the supplemental methods. Expression analysis was performed to examine expression of PVRIG in spleen, lymph node, and tumor in various cell subsets. Cell functional assays demonstrating a T cell modulatory activity for mouse PVRIG were established using WT and PVRIG$^{-/-}$ T cells and PVRL2 Fc or PVRL2 ectopically expressed target cells as detailed in the supplemental materials and methods. CT26, MC38, and B16/Db-hmgp100 tumor models were performed as described in the supplemental methods. All studies were approved by the Institutional Animal Care and Use committee at the Tel-Aviv University (Tel-aviv, Israel) or Johns Hopkins University (Baltimore, USA).

Results

PVRIG Expression is Highest on Effector T Cells of Peripheral Blood and Tumors

Figures 83A, 83B, 83C:
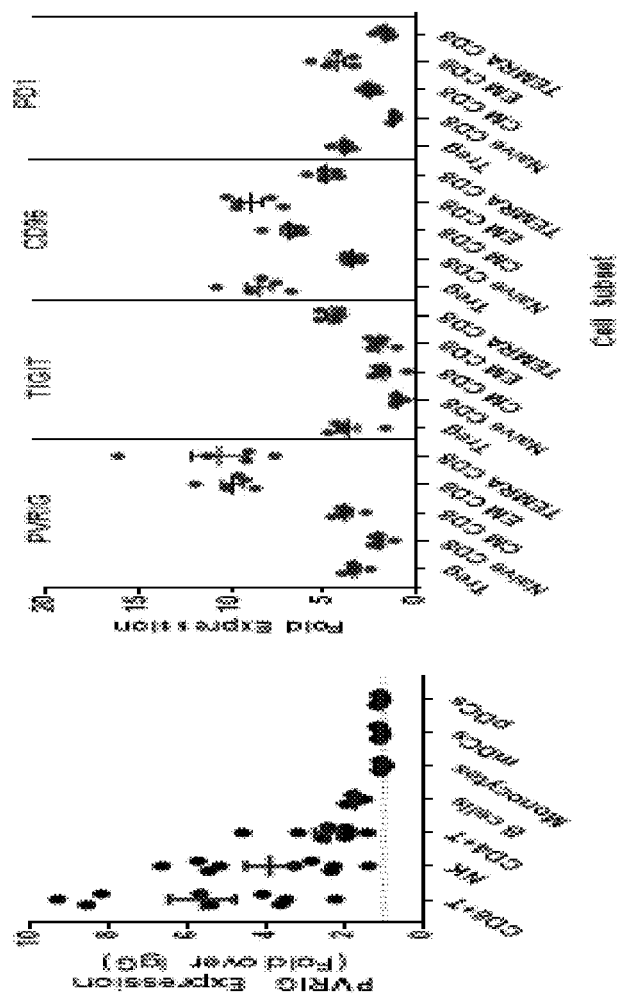
Figure 90B:
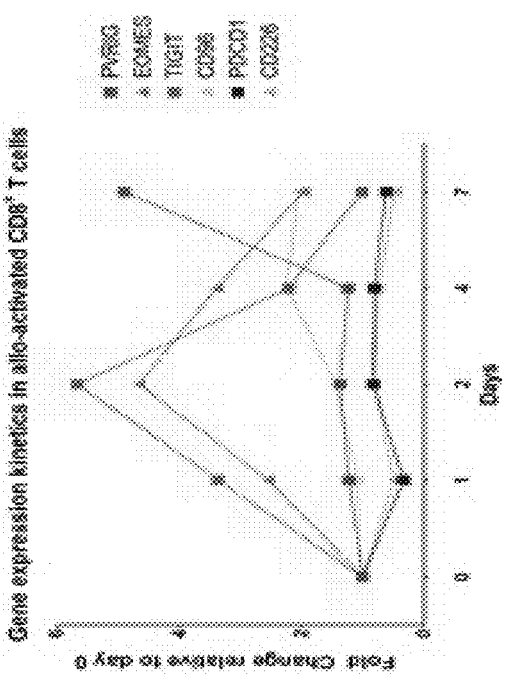
Figure 90A:
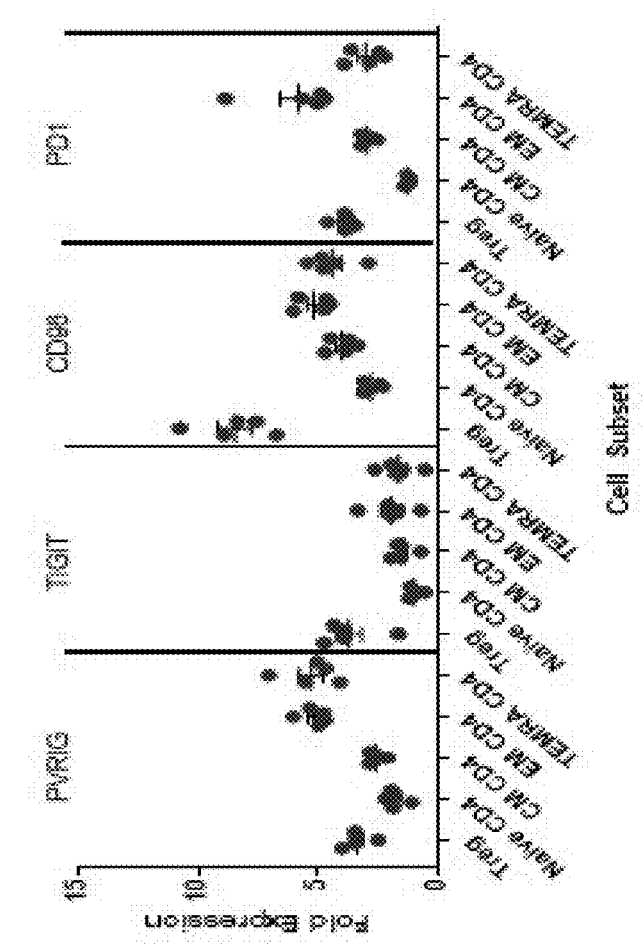

The Ig superfamily (IgSF) consists of hundreds of proteins but only a few of them are T cell inhibitory receptors. Proteins of the IgSF tend to evolve quickly (24) and therefore sequence similarity among these proteins is generally low and is not optimal for identifying novel immune receptors. To identify novel immune checkpoints, we developed bioinformatic algorithms based on shared genomic and proteomic characteristics among known immune checkpoints, such as gene structure, protein domains, predicted cellular localization and expression pattern. Using these algorithms, PVRIG was identified as a novel immune receptor. A report has recently also demonstrated that human PVRIG (CD112R) binds to PVRL2 and inhibits T cell function (15). However, the relevance of this pathway in regulating tumor immune surveillance has not been reported. Here, we have elucidated the expression and function of PVRIG and PVRL2 in human cancers and preclinical tumor models. In peripheral blood from healthy donors, PVRIG was expressed exclusively on lymphocytes, with highest expression on CD8 T cells and NK cells (FIG. 83A). Further subset analysis of T cells showed highest PVRIG expression on CD8 or CD4 memory/effector T cell subsets in comparison with Treg subset (FIG. 83B, FIG. 90A). The predominantly memory T-cell expression pattern differentiates PVRIG from other receptors in the family (TIGIT, CD96) which tend to have equal or higher expression on Tregs compared to memory/effector T cells. We further compared the expression kinetics of PVRIG and TIGIT post T cell activation in 2 assay systems (CMV recall response FIG. 83C, DC-MLR FIG. 83D, FIG. 90B) and show that PVRIG has delayed kinetics of induction and more sustained expression at the late timepoint as compared to TIGIT. The preferential expression of PVRIG on memory/effector cells as compared to TIGIT suggests a unique role for PVRIG in regulating T cell responses.

Figure 83F:
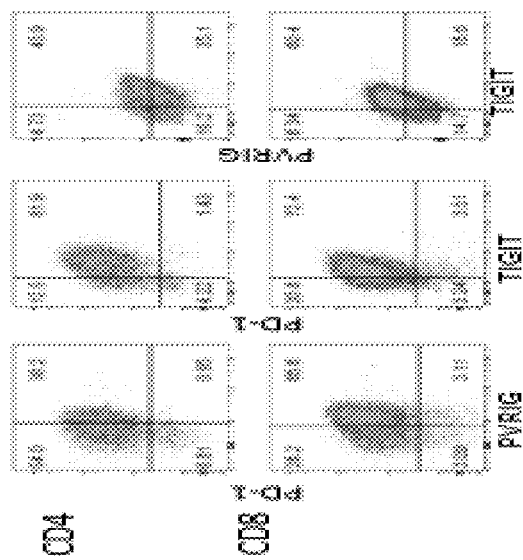
Figure 83E:
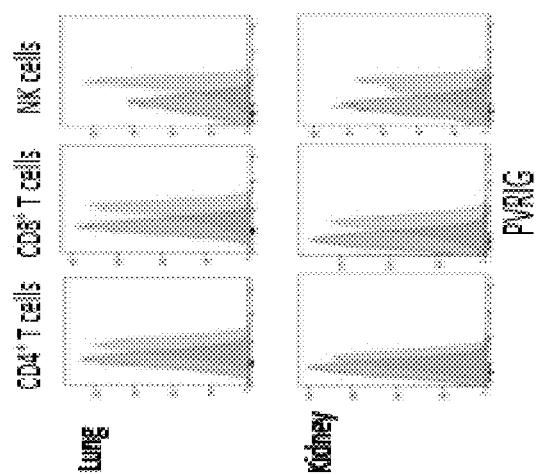
Figure 83D:
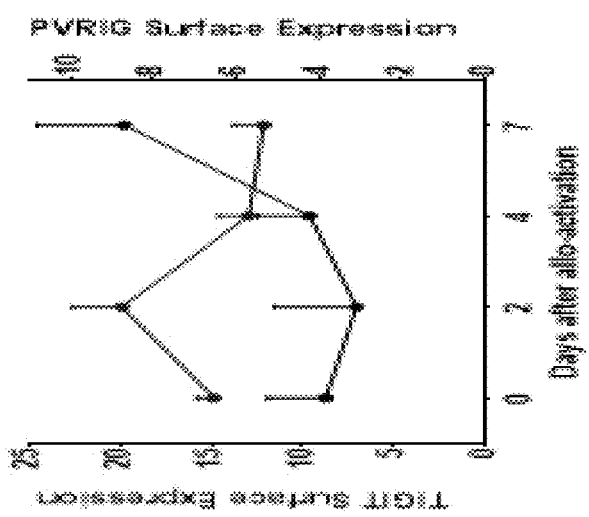
Figure 83H:
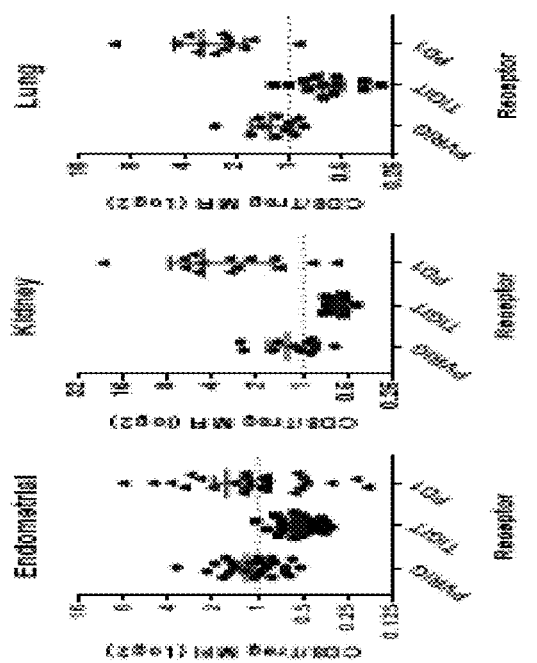
Figure 83G:
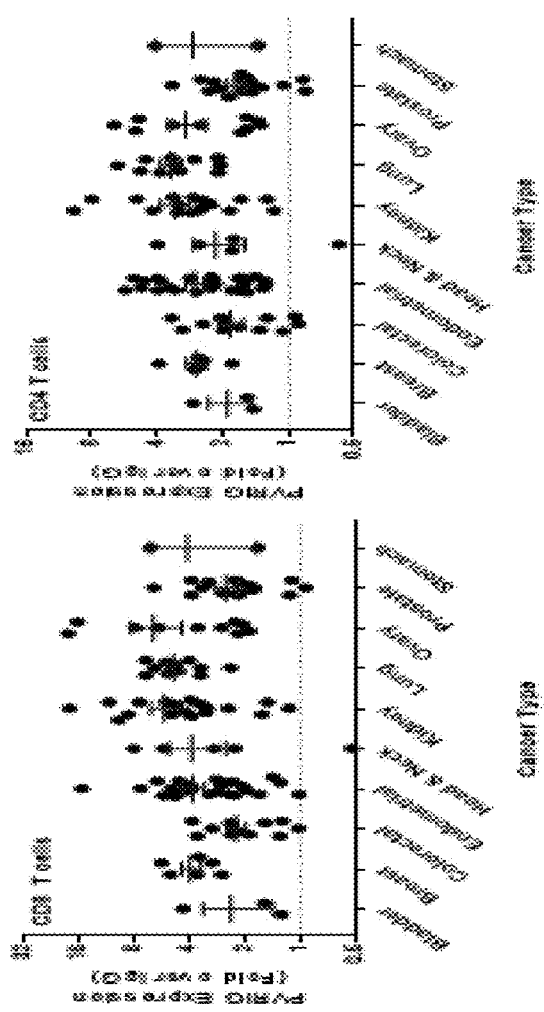
Figure 90D:
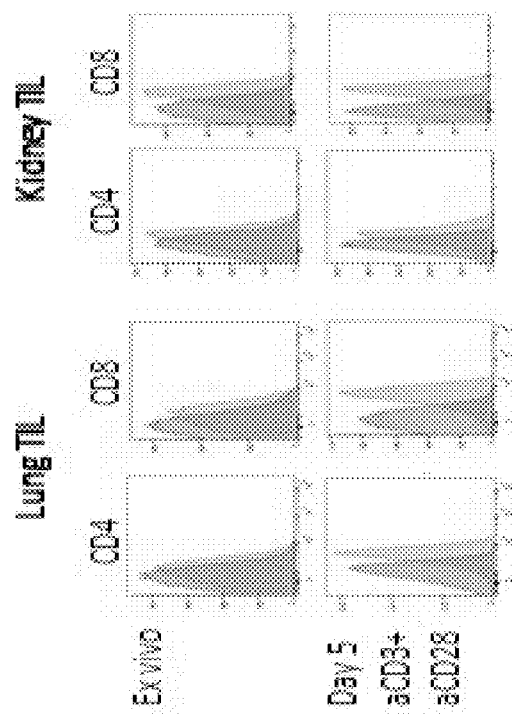
Figure 90C:
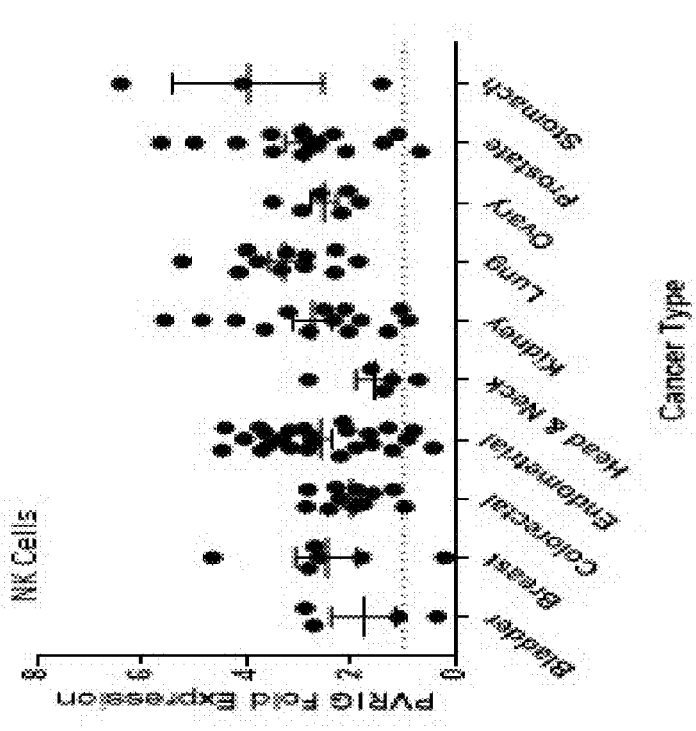

The delayed and sustained induction of PVRIG expression on T cells after activation suggested that it could be expressed in the tumor microenvironment. Next, we analyzed the expression of PVRIG on leukocytes from dissociated human tumors directly ex vivo by FACS. Expression of PVRIG was detected on CD8 T cells, CD4 T cells, and NK cells from multiple tumor types (FIG. 83E-G, FIG. 90C). PVRIG was co-expressed with PD-1 and TIGIT on CD4 and CD8 T cells (FIG. 83F). On average, higher expression was detected on CD4$^+$ and CD8$^+$ TILs from breast, endometrial, head and neck, lung, kidney, and ovarian tumors as compared to bladder, colorectal, and prostate. In tumor samples in which PVRIG expression was low/not present ex vivo, activation with anti-CD3 and anti-CD28 enhanced the expression of PVRIG, suggesting that TIL expression of PVRIG can be further induced upon re-activation (FIG. 90D). For colon, lung, kidney, endometrial, and ovarian tumors, we were able to obtain normal adjacent tissue from the same patient and perform a comparison of PVRIG expression on lymphocytes isolated from the tumor vs normal tissue. TILS showed a significant induction of PVRIG on CD4 and CD8 T cells as compared to cells isolated from matching normal adjacent tissues (NAT) (FIG. 90E). As with PBMCs, we further compared PVRIG, TIGIT, and PD1 expression on Tregs vs CD8 T cells from lung, endometrial, and kidney tumors. On TILS, TIGIT expression was higher on Tregs compared to CD8 T cells whereas for PVRIG and PD1, similar or higher expression was observed on CD8 T cells compared to Tregs (FIG. 83H). Next, we examined the co-regulation of PVRIG, TIGIT, and PD-1 on T cell populations by correlation analysis of either the magnitude of expression on TILS ex vivo or the magnitude of the fold change in expression between tumor and NAT. In both analyses, CD4 and CD8 T cells displayed a positive and significant correlation between PVRIG and PD1 or TIGIT on (FIG. 90F). Taken together, these data demonstrate that PVRIG is expressed on T cells and NK cells from multiple human cancers, placing PVRIG as a novel inhibitory receptor target that may be critical in regulating T cell function in the tumor.

PVRL2 Expression is Enhanced in Tumors Tissue Compared to Normal Adjacent Tissue As PD-L1 expression has been demonstrated to help predict responses to PD-1 inhibitors, we examined whether the expression of PVRL2 was concomitant with expression of its cognate receptor, PVRIG, in human cancer tissues. Using an anti-PVRL2 antibody that we validated for staining FFPE samples (FIG. 91A), we stained tumor microarrays (TMA) composed of lung, colon, skin, breast, ovarian/ endometrial, and kidney cancer tissues and scored each core based on prevalence and intensity of PVRL2 expression. PVRL2 expression was not present or minimally expressed in the majority of normal tissue samples from these organs. In tumor tissues, PVRL2 expression on tumor cells was detected in ~50-70% of lung, colon, breast, and ovarian/ endometrial cancers (FIG. 84A, 84F). Expression in kidney cancer samples ranged from 20-40% whereas expression in melanoma was the lowest (~10%) (FIG. 84A, 84F). PVRL2 expression was detected on tumor cells and immune cells at the invasive front (FIG. 84B). To determine the specific immune cell subsets expressing PVRL2, we performed flow cytometry on freshly dissociated tumors. Expression of PVRL2 was detected on $CD45^+$ immune cells, particularly myeloid cells (e.g. $CD14^+$ tumor associated macrophages (TAMs) and myeloid DCs) and on $CD45^-$ non-immune cells from multiple tumor types (FIG. 84C, D). No expression of PVRL2 was detected on lymphocytes (data not shown). Comparison of PVRL2 expression on $CD45^-$ cells and TAMs isolated from colon, lung, kidney, endometrial, and ovarian tumors showed a significant induction of PVRL2 on cells isolated from the tumor as compared to cells isolated from matching NAT of the same donor (FIG. 92). For samples where we obtained PVRIG and PVRL2 expression, we examined expression of PVRIG on lymphocytes compared with PVRL2 on myeloid and on $CD45^-$ cells from multiple tumor types. Of the cancer types examined, endometrial, lung, and kidney cancers had the highest prevalence of $PVRIG^{hi}$ lymphocytes and $PVRL2^{hi}$ TAMs or $CD45^-$ non-immune cells (FIG. 842E, FIG. 93). Integrating data the TMA and dissociated tumor studies, we demonstrate that breast, endometrial, lung, head and neck, kidney, and ovarian tumors may representative a responsive tumor type for PVRIG antagonism.

Compared to PD-L1, PVRL2 Expression is Differentially Regulated and Present in $PD-L1^-$ Tumors As PVRIG and PD-1 can be co-expressed on tumor-infiltrating lymphocytes (TILs), we also examined the co-expression of PVRL2 and PD-L1 on the same tumor by staining serial sections of the same TMA. PVRL2 expression on tumor cells was clearly detected in $PD-L1^-$ tumor samples (as defined by no membranous PD-L1 staining on tumor cells or immune cells) at similar frequency and average score compared to $PD-L1^+$ samples. (FIG. 85A, FIG. 84F). On immune cells, 3 of 5 tumors in which PVRL2 expression was detected on immune cells also expressed PD-L1 (data not shown), but the small numbers of samples makes it difficult to conclude on immune cell co-expression of PD-L1 and PVRL2. The expression of PVRL2 on tumor cells in PD-L1 negative tumors suggested that PVRL2 expression was more prevalent than PD-L1 in some tumors types and that targeting this pathway may be particularly effective in $PD-L1^-$ tumors. Whereas PD-L1 is induced primarily by IFN-γ as a mechanism of adaptive resistance (28), PVRL2 is modulated by genomic stress, DNA damage, and tumor suppressor genes (29,30). To further understand the distinct regulation of PD-L1 and PVR/PVRL2, we next assessed the regulation of PVR, PVRL2 and PD-L1 expression in tumor cell lines and in monocyte-derived DCs by exposure to various inflammatory stimuli (FIG. 85D). Treatment of DCs with pro-inflammatory signals generally lead to an increase in PVR, PVRL2, and PD-L1 expression, demonstrating that PVR, PVRL2, and PD-L1 expression are increased upon DC maturation. In contrast, treatment of epithelial cells with IFN-γ increased expression of PD-L1 but had no effect on the high baseline expression of PVRL2 (FIG. 85E), supporting differential regulation of PVRL2 expression in comparison with PD-L1 by IFN-γ. In summary, these findings indicate that PD-L1 and PVRL2 can be co-regulated on antigen presenting cells (APCs) such as DCs but can be differentially regulated on epithelial cells. The presence of PVRL2 in PD-L1-negative tumors suggests that targeting this pathway may be of potential benefit in patients that are non-responsive to or progress on PD-1 inhibitors.

CHA.7.518.1.H4(S241P) is a High Affinity Humanized Monoclonal Antibody to PVRIG that Disrupts the Interaction of PVRIG to PVRL2

Figures 94A, 94B:
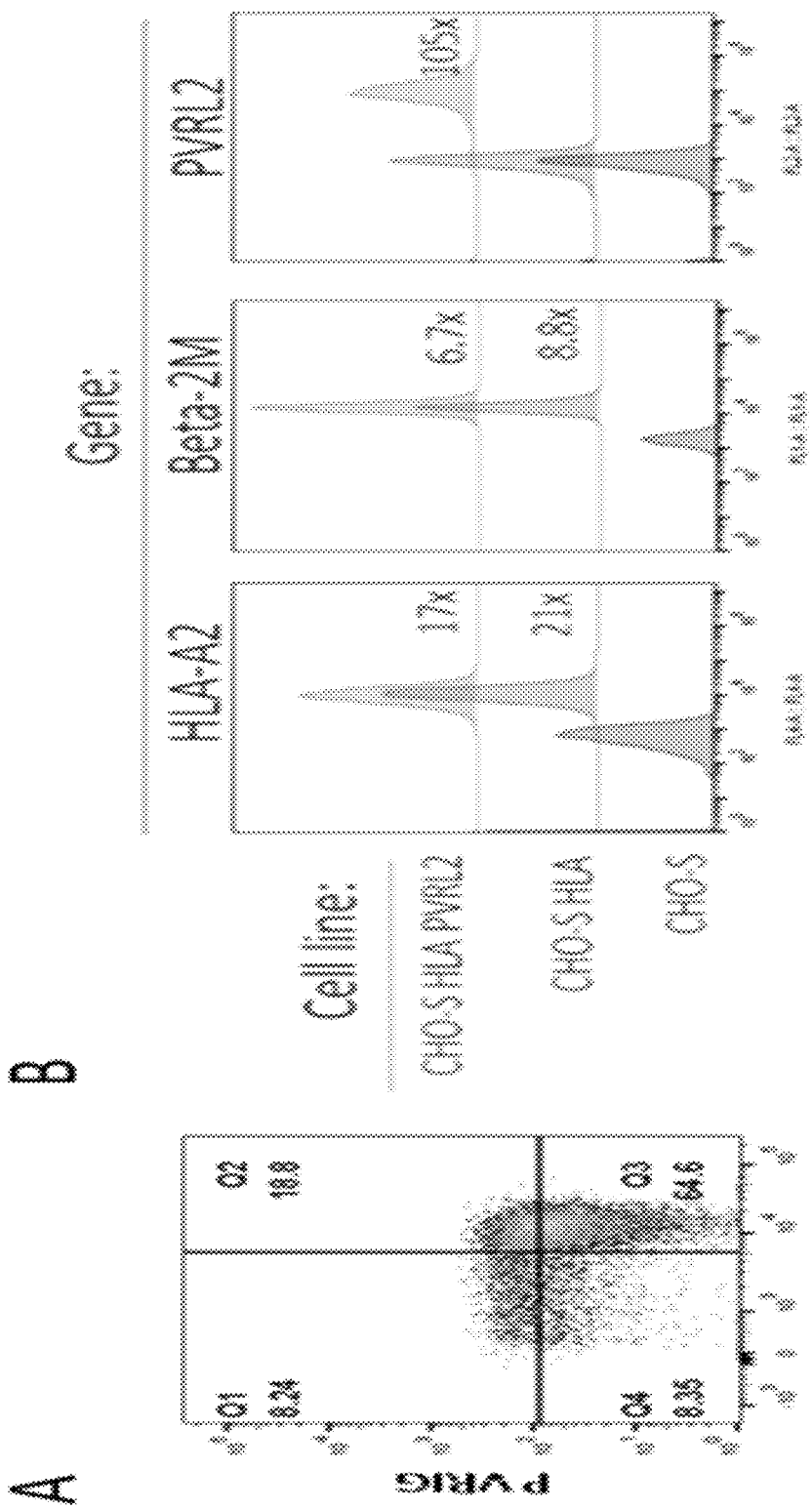

To examine the functional consequences of antagonizing human PVRIG-PVRL2 interactions, we generated a high affinity, antagonistic anti-PVRIG antibody, CHA.7.518.1.H4 (S241P), which blocks the interaction of PVRIG and PVRL2. This antibody selectively bound HEK293 cells ectopically expressing human PVRIG or cynomolgus macaque PVRIG and also bound Jurkat cells that endogenously express PVRIG with sub-nanomolar affinity (FIG. 86A). In biochemical assays, CHA.7.518.1.H4(S241P) blocked the interaction of PVRIG Fc with $PVRL2^+$ HEK293 cells (FIG. 86B) and also blocked PVRL2 Fc binding to $PVRIG^+$ HEK293 cells (FIG. 86C). Using this antibody, we observed a functional effect of an antagonistic anti-PVRIG in several T cell assays. Artificial antigen-presenting cells (aAPC) ectopically expressing a cell surface anti-CD3 antibody and human PVRL2 were generated and co-cultured with primary human CD4 T cells, either in the presence of anti-PVRIG (CHA.7.518.1.H4(S241P)) or isotype control. PVRIG expression was induced on proliferating CD4 T cells upon co-culture with the CHO anti-CD3 aAPC (FIG. 94A). Antagonism of PVRIG with CHA.7.518.1.H4(S241P) enhanced proliferation of CD4 T cells from multiple donors (FIG. 86D). We also tested the effect of anti-PVRIG on 2 human gp100 reactive CD8 T cell lines that were derived from melanoma tumors. These T cell lines were individually co-cultured with aAPCs expressing HLA-A2 and PVRL2 (FIG. 94B) in the presence of isotype control IgG or anti-PVRIG antibodies. As observed in both lines, anti-PVRIG increased IFN-γ and TNF-α production by ~20-50%. In a dose response assessment, CHA.7.518.1.H4 (S241P) displayed single digit nano-molar EC50 values in multiple assays (FIG. 94C, D). These data collectively demonstrate that antagonizing PVRIG-PVRL2 interactions with CHA.7.518.1.H4(S241P) resulted in increased T cell activation.

CHA.7.518.1.H4(S241P) in Combination with TIGIT or PD-1 Inhibitors Resulted in Synergistic Enhancement of T Cell Function.

Figure 86G:
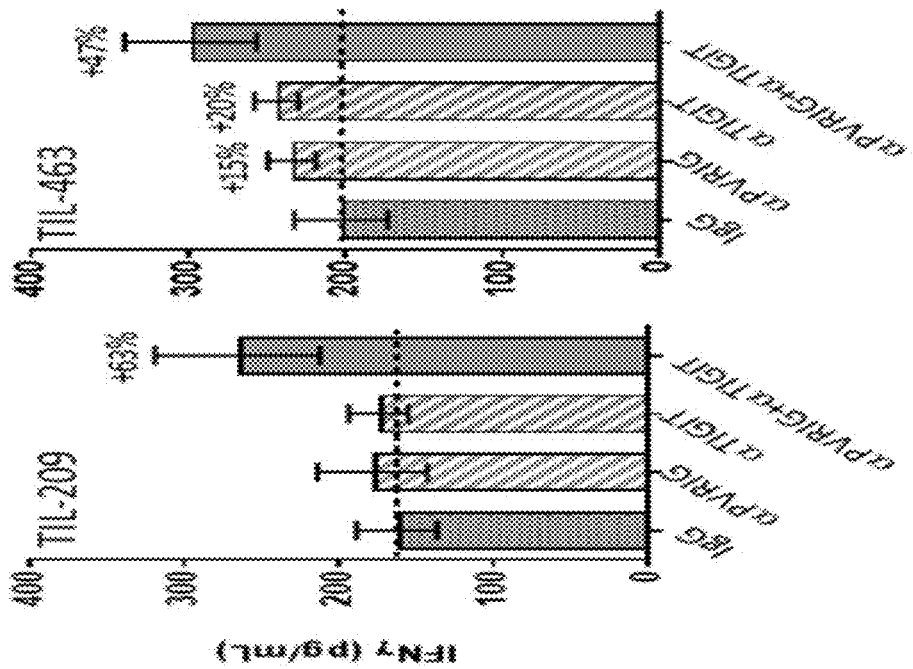
Figure 86F:
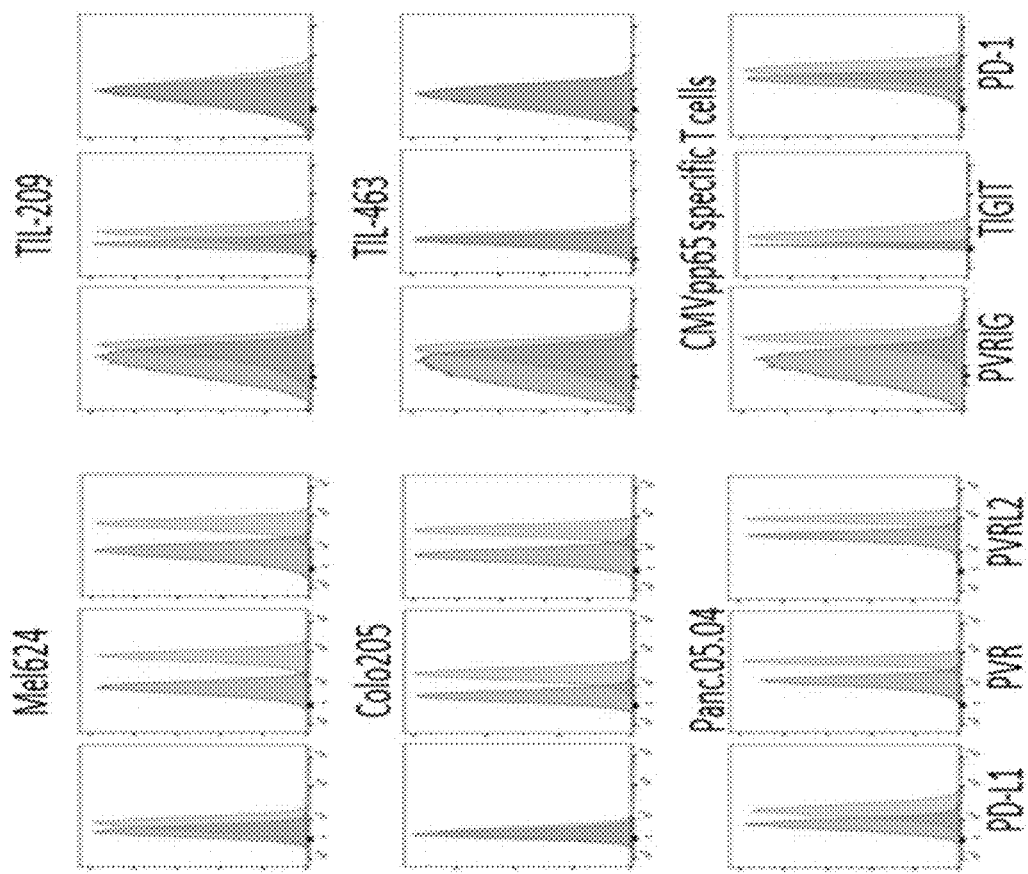

Combination of PVRIG and TIGIT blockade synergistically increased CD4 T cell function in a T cell-dendritic cell co-culture assay (15), suggesting a role for this pathway in regulating T cell-APC interactions. The effects of PVRIG and TIGIT blockade on CD8 T cells in a tumor cell co-culture setting has not been reported. As our tumor expression profiling demonstrated expression of PVRL2 on $CD45^-$ immune cells, we further explored the effect of targeting this pathway in T cell—tumor cell co-cultures using 2 T cell assay systems. We first performed a co-culture of 2 gp100 tumor antigen specific CD8 T cell lines with a melanoma cell line, MEL624, in the presence of anti-PVRIG, anti-TIGIT, or isotype control antibodies, either individually or in combination. MEL624 cells express both PVR and PVLR2 and both TIL-209 and TIL-463 expressed PVRIG, TIGIT, and PD-1 (FIG. 86F). On TIL-209, we observed that anti-PVRIG or anti-TIGIT alone did not increase IFN-γ and that the combination of anti-PVRIG and anti-TIGIT synergistically increased IFN-γ production (FIG. 86G). On TIL-463, we observed that anti-PVRIG or anti-TIGIT modestly increased IFN-γ production, and that combination of anti-PVRIG and anti-TIGIT additively increased IFN-γ (FIG. 86G). In an additional assay system, we utilized CMVpp65-reactive CD8 T cells as a model system to study human T cell responses. HLA-A2$^+$ CMVpp65 CD8 T cells were expanded in the presence of CMVpp65 (495-503) and expression of PVRIG, TIGIT, and PD-1 was observed on day 10 (FIG. 86F). PVRIG was expressed on CMVpp65 specific CD8 T cells at similar magnitude to what was observed in human cancer samples (FIG. 83). As target cells, we identified a PD-L1$^{hi}$ (Panc05.04) and a PD-L1$^{lo}$ (Colo205) HLA-A2$^+$ cancer cell line that both expressed similar amounts of PVR and PVRL2 (FIG. 86F). We next performed a co-culture of the CMVpp65 reactive T cells with HLA-A2$^+$ tumor cell lines pulsed with pp65 (495-503) peptide in the presence of blocking antibodies to PVRIG, TIGIT, and/or PD-1. We observed that anti-PVRIG Ab increased IFN-γ by ~50% in the co-culture with Panc05.04 cells and minimally in the co-culture with Colo205 (FIG. 86I). Combination of anti-TIGIT with anti-PVRIG Ab synergistically increased IFN-γ production on both target cell lines, resulting in a greater increase in IFN-γ compared to PD-1 antibody alone (FIG. 86H). Combination of anti-PVRIG and anti-PD-1 also led to synergistic increases in IFN-γ production as compared to individual antibody (FIG. 86I). Taken together, these data suggest a potent synergy of combining PVRIG and TIGIT or PVRIG and PD1 blockade in increasing activation of human CD8 T cells upon interaction with tumor cells.

Figure 95D:
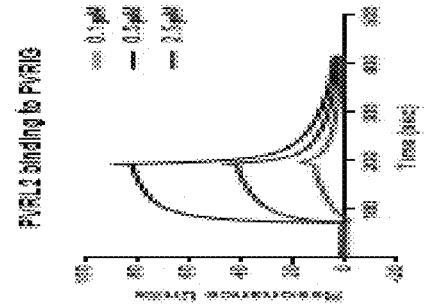
Figure 95C:
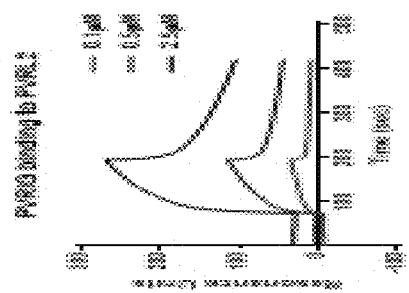
Figure 95B:
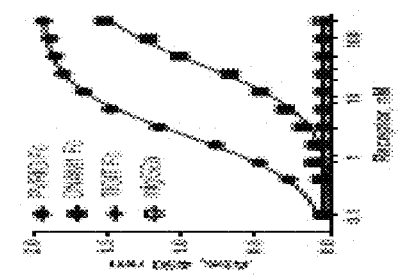
Figure 95A:
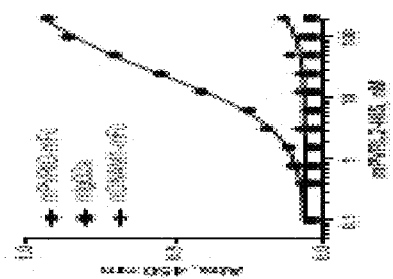
Figure 97B:
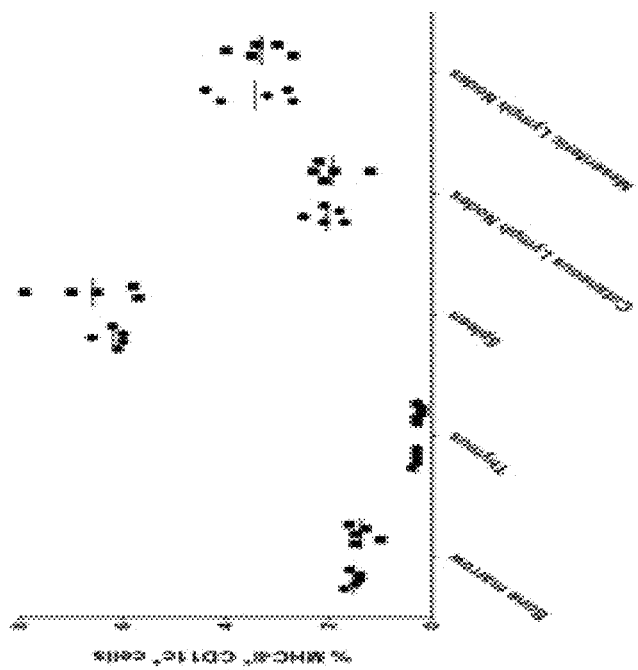
Figure 97A:
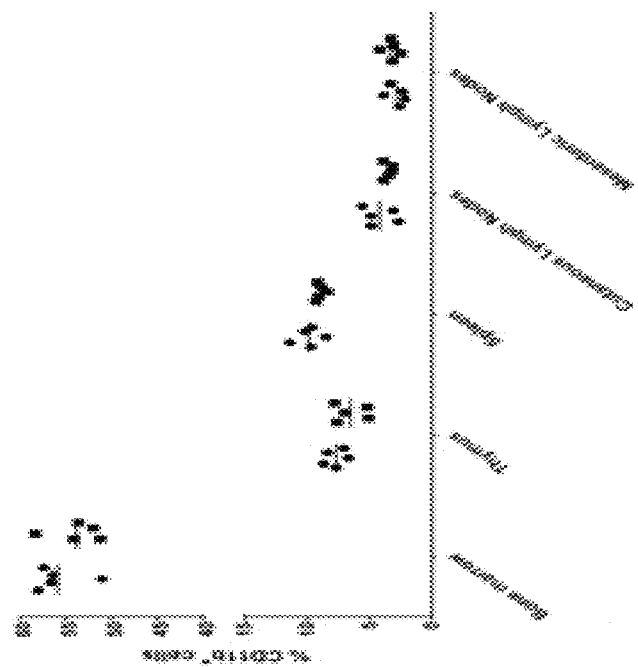
Figure 97C:
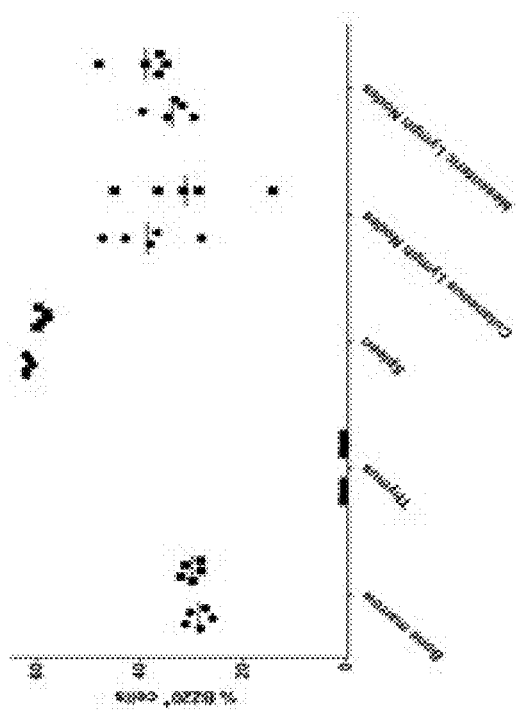
Figure 97D:
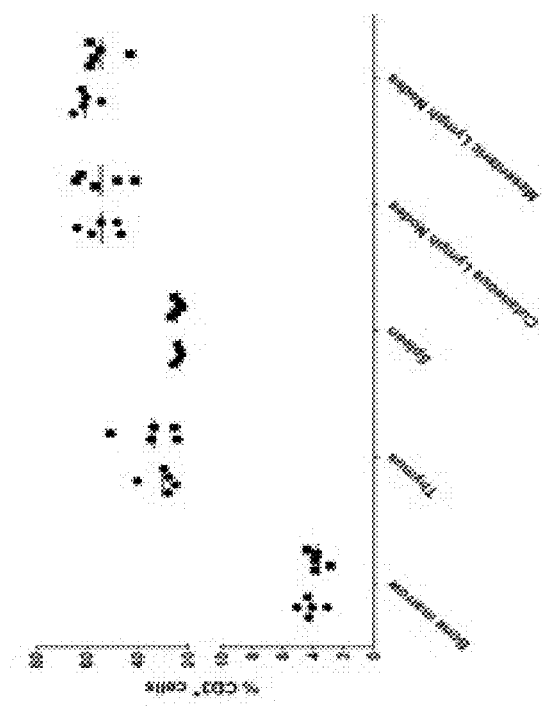
Figure 97I:
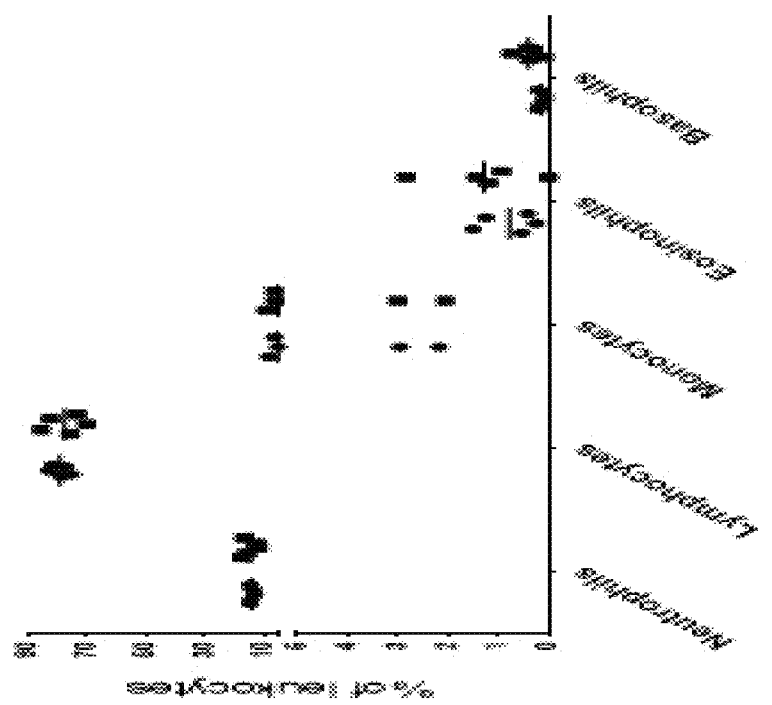
Figure 97H:
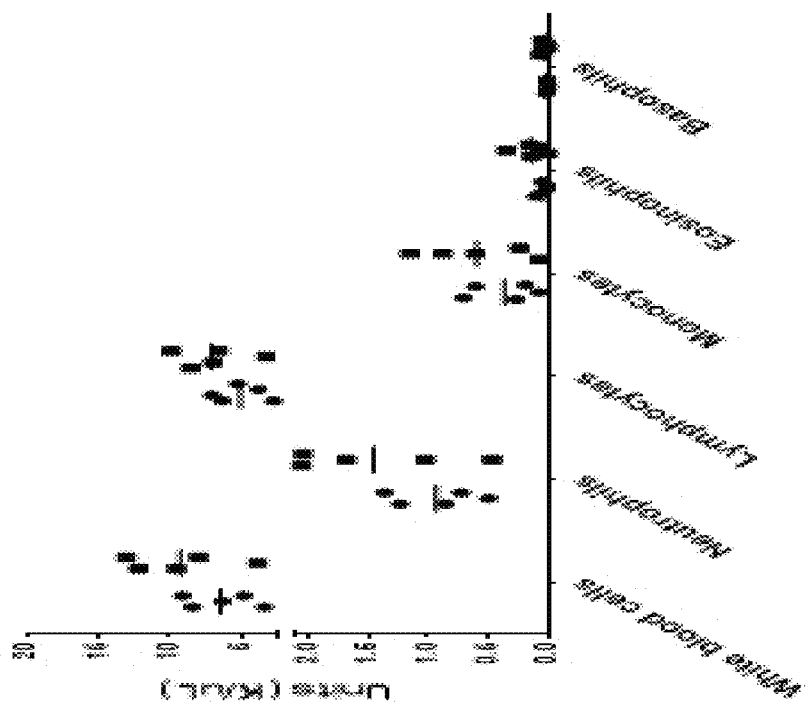
Figure 98A:
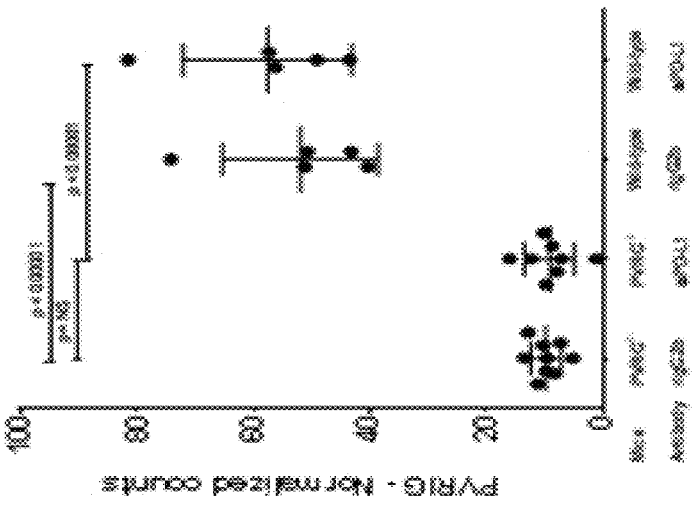
Figure 98B:
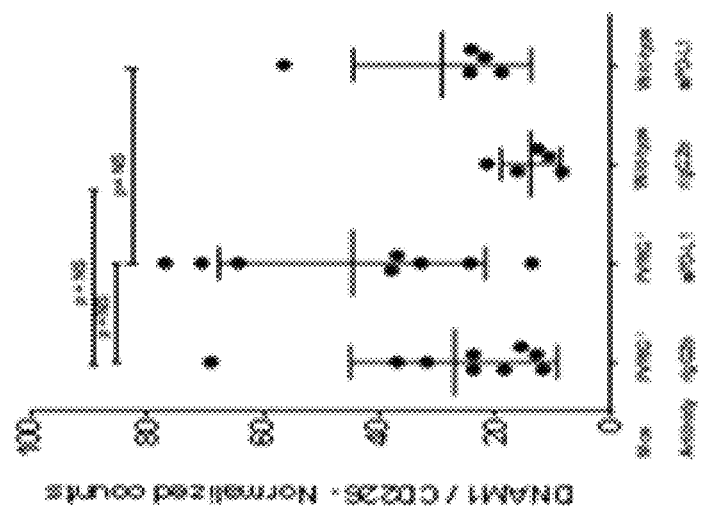
Figure 98C:
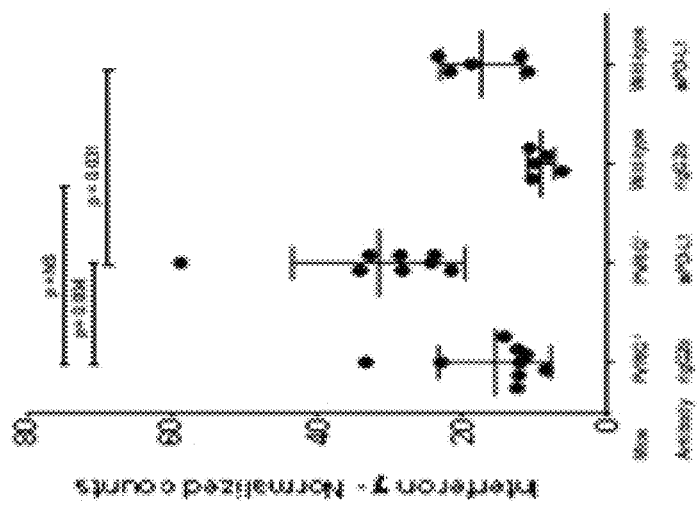
Figure 98D:
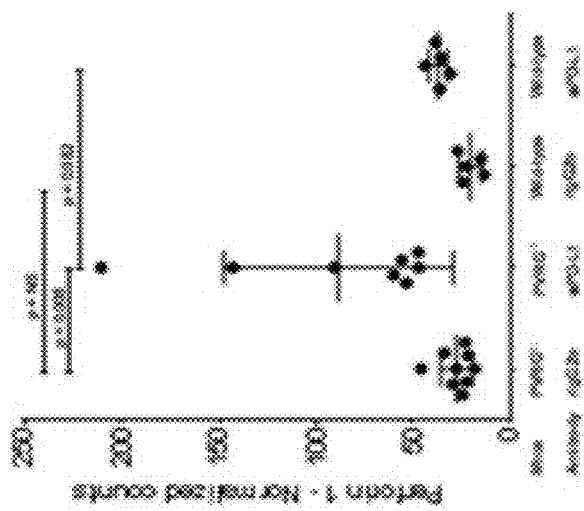
Figure 98E:
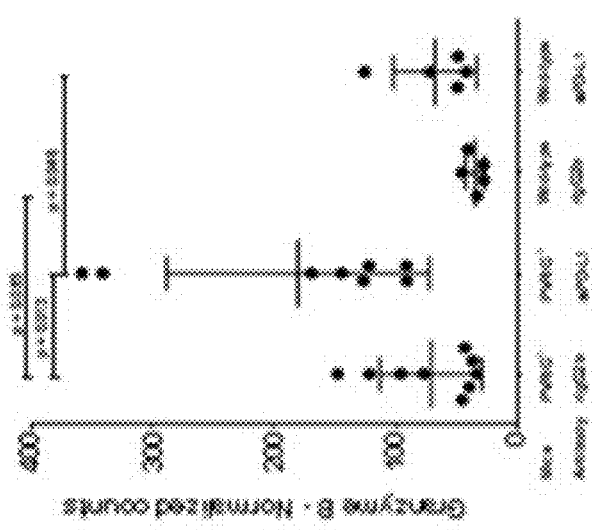
Figure 98F:
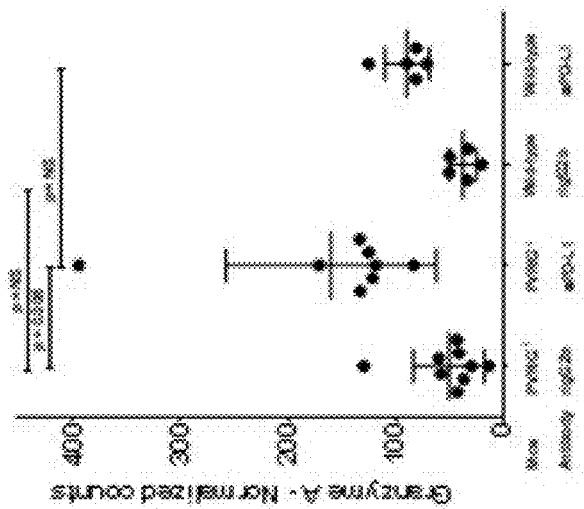
Figure 98I:
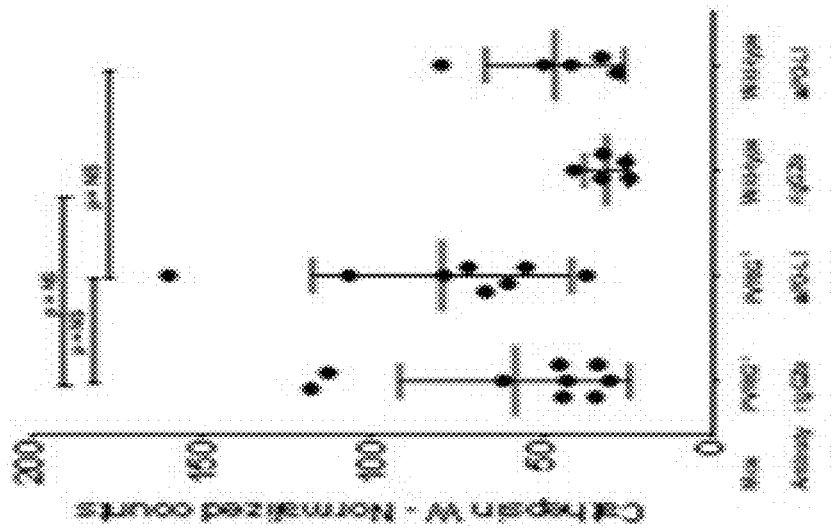
Figure 98H:
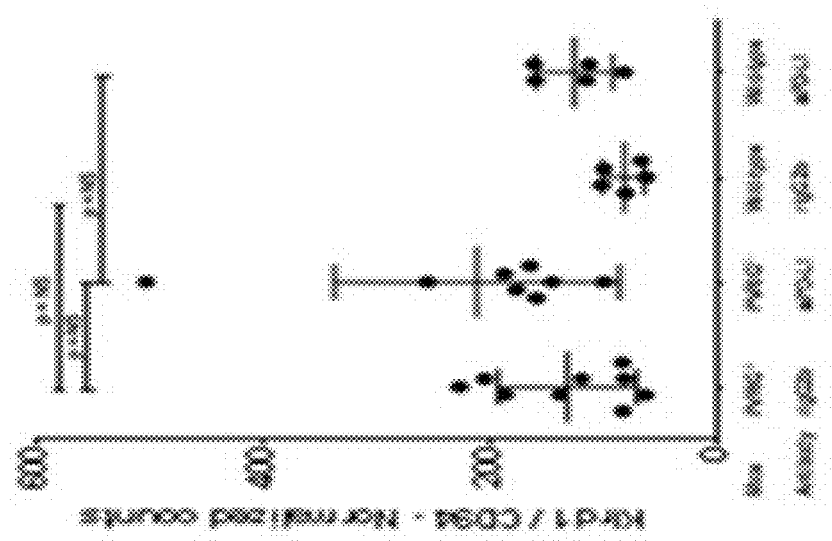
Figure 98G:
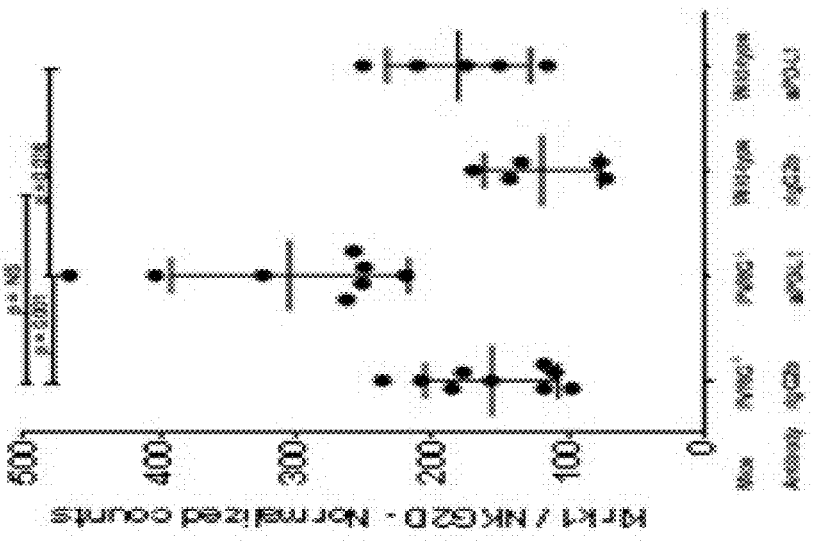

PVRIG Deficiency Resulted in Increased T Cell Proliferation and Reduced Tumor Growth Although the sequence for mouse PVRIG and its interaction with mouse PVRL2 has been reported, the expression profile and immune modulatory activity of mouse PVRIG is not well understood. We first analyzed mPVRIG RNA expression and transcript in NK, NKT and T cells (FIG. 87A). Activated mouse CD8 T cells had elevated PVRIG transcripts with delayed induction kinetics compared to TIGIT (FIG. 87B). We confirmed that that recombinant mPVRIG bound to mPVRL2 protein by surface plasmon resonance (SPR) and ELISA performed in several assay orientations (FIG. 95A-D). We also observed an interaction between mPVRIG and mPVR, although the affinity was approximately 10× less than the interaction with mPVRL2 (FIG. 95E). To determine whether PVR or PVRL2 is the dominant ligand for mPVRIG, we tested the binding of mouse PVRIG Fc to B16F10 cells which express PVR and PVRL2 (data not shown). PVRIG Fc showed a dose dependent binding to B16F10 cells that was completely abolished upon PVRL2 siRNA knockdown in B16F10 cells (FIG. 95F). In comparison, the binding of PVRIG Fc fusion protein was slightly, but consistently, reduced following PVR knockdown (FIG. 95F) suggesting that a very weak interaction occurs between mPVRIG and mPVR. Taken together, these results demonstrate that in mice, PVRL2 is the primary ligand for PVRIG, as is the case in human. To delineate the role of PVRIG in immune responses, we generated PVRIG deficient ($^{-/-}$) mice (FIG. 96). PVRIG$^{-/-}$ mice were born at the expected Mendelian ratios, displayed no overt phenotype up to 10 months of age, and at 8 weeks of age had similar leukocyte cellularity (peripheral and lymphoid tissue) when compared to wild type mice (FIG. 97). Wild-type (WT) CD8 T cells and NK cells express PVRIG and no expression of PVRIG was detected on PVRIG$^{-/-}$ cells (FIG. 87C). To examine the role of PVRIG in regulating mouse T cell responses, we examined the proliferation of WT and PVRIG$^{-/-}$ T cells in 2 assay systems. WT or PVRIG$^{-/-}$ T cells were activated with immobilized anti-CD3 in the presence of soluble PVRL2 Fc or control Fc protein. Soluble PVRL2 Fc significantly inhibited WT CD4$^+$ T cell proliferation but not PVRIG$^{-/-}$ CD4$^+$ T cell proliferation (FIG. 87D), suggesting that PVRIG$^{-/-}$ cells lack an inhibitory signal. To evaluate the role of mouse PVRIG in CD8$^+$ T cell interaction with tumor cells, PVRIG$^{-/-}$ mice were bred to pmel TCR transgenic mice, which express a transgenic TCR specific to gp100$_{25-33}$ (28). Activated PVRIG$^{-/-}$ or WT Pmel CD8+ T cells were co-cultured with B16-Db/gp100 melanoma tumor cells that endogenously express PVRL2 (data not shown) and activation and effector function evaluated. PVRIG$^{-/-}$ pmel CD8$^+$ T cells showed enhanced degranulation and production of effector cytokines (IFN-γ and TNF-α) compared to WT cells (FIG. 87E). These data indicate that mouse PVRIG inhibits activation and effector function of tumor-specific T cells upon co-culture with PVRL2$^+$ tumor target cells.

Figure 88E:
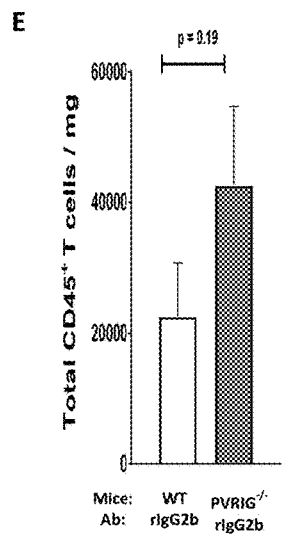
Figure 88G:
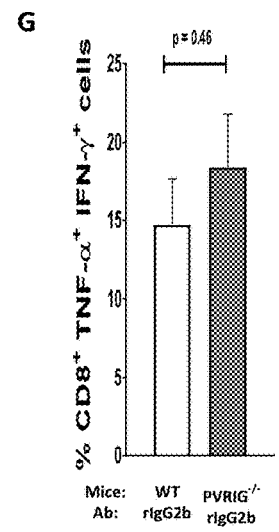
Figure 88F:
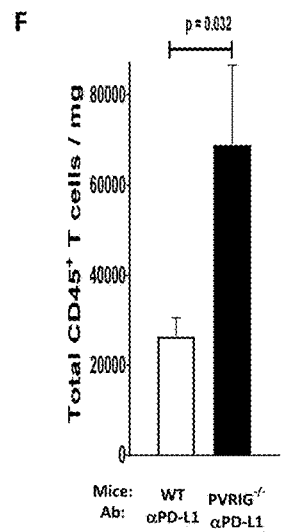
Figure 88H:
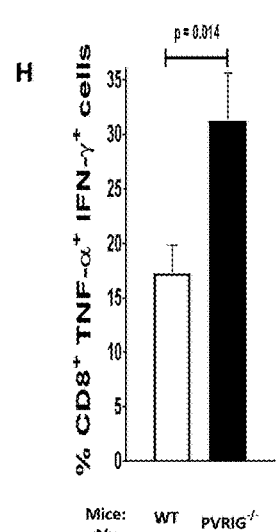

We next studied the effects of PVRIG deficiency on tumor growth in the MC38 syngeneic model. PVRIG$^{-/-}$ mice displayed significantly reduced tumor growth compared to WT mice (p<0.05; FIG. 88A-B). Moreover, PD-L1 blockade, begun on day 14, further amplified anti-tumor responses and reduced tumor growth in PVRIG$^{-/-}$ mice compared to anti-PD-L1-treated WT mice (p=0.052) (FIG. 88C-D). To assess the functional effects of PD-L1 blockade on PVRIG$^{-/-}$ and WT tumor micro-environments, we harvested tumors and tumor-draining lymph nodes from each of the four experimental cohorts on day 18, when groups had received 2 doses of either isotype or anti-PD-L1 but no differences in tumor volume were observed, and performed flow cytometry for immune subset composition and intracellular cytokines. Immune cell (CD45$^+$) trafficking into PVRIG$^{-/-}$ tumors was enhanced moderately (88% relative to WT tumors) as were CD8$^+$ T cells (92% compared to WT tumors) and IFN-γ-producing CD8$^+$ T cells (110% increase over WT tumors; FIG. 88E). In combination with PD-L1 blockade, infiltration of CD45$^+$ cells was increased significantly in PVRIG$^{-/-}$ tumors (160% relative to tumors from anti-PD-L1-treated WT mice; p=0.032; FIG. 88F). Anti-PD-L1-treated PVRIG$^{-/-}$ tumors also had greater numbers of total CD8$^+$ T cells per tumor weight (252% increase) and IFN-γ-producing CD8$^+$ T cells (297% increase), compared to treated anti-PD-L1 treated WT tumors (FIG. 88F). We also observed that PVRIG$^{-/-}$ mice had unaltered effector tumor-infiltrating CD4$^+$ T cell and Foxp3$^+$ Treg numbers regardless of PD-L1 blockade (data not shown). The rescue of immune dysfunction in PVRIG$^{-/-}$ tumors, particularly following PD-L1 blockade, was mirrored in the tumor-draining lymph nodes that had increased frequencies of IFN-γ$^+$TNF-α$^+$ effector CD8$^+$ T cells relative to anti-PD-L1-treated WT mice (FIG. 88G-H). Taken together, these data demonstrate that PVRIG ablation, results in reduced tumor growth associated with an increased anti-tumor immune response, in particular when combined with anti-PD-L1 antibody treatment.

Figure 89B:
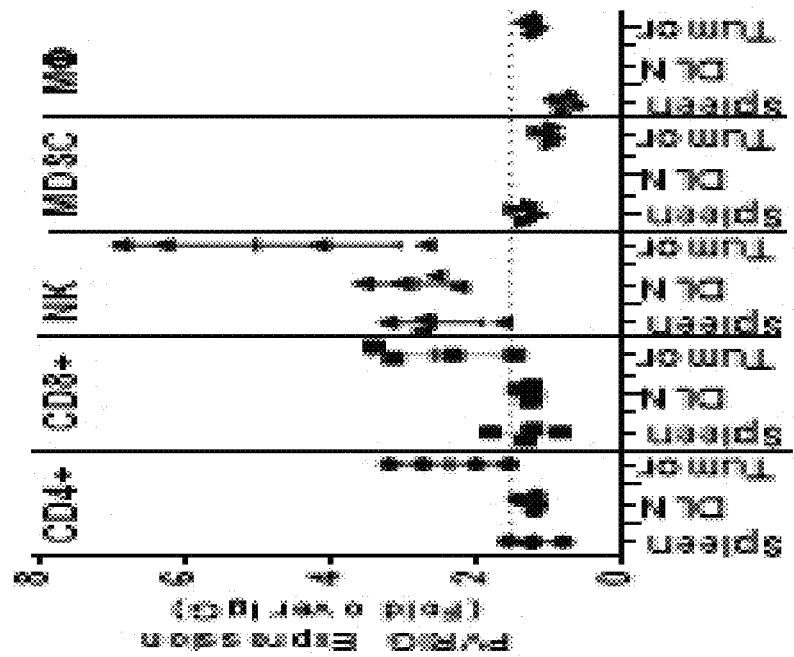
Figure 89A:
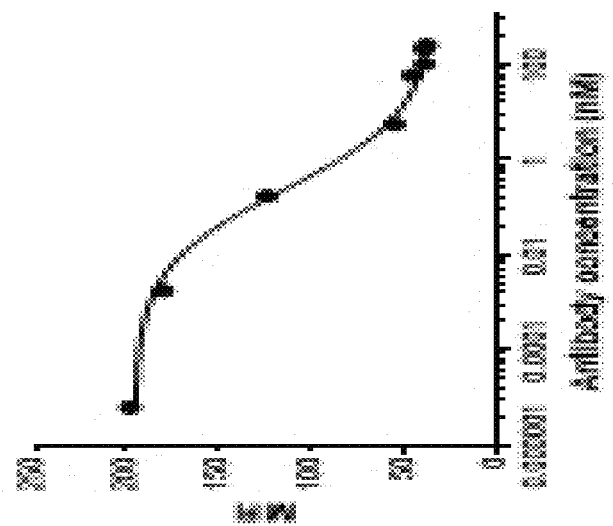
Figure 89D:
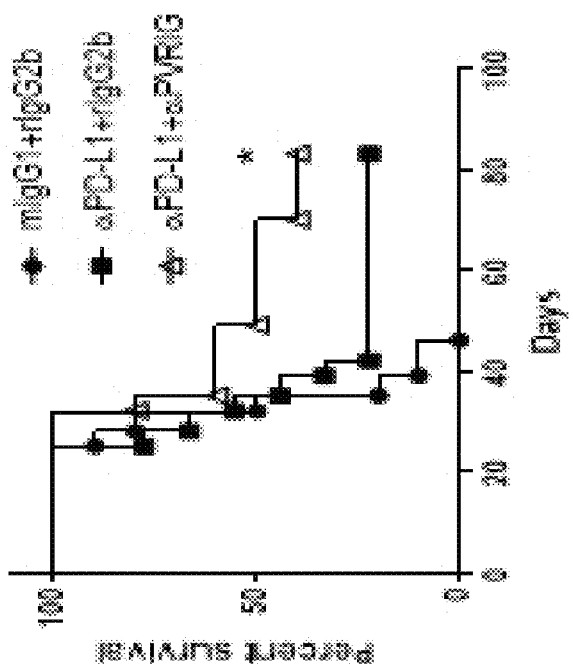
Figure 89C:
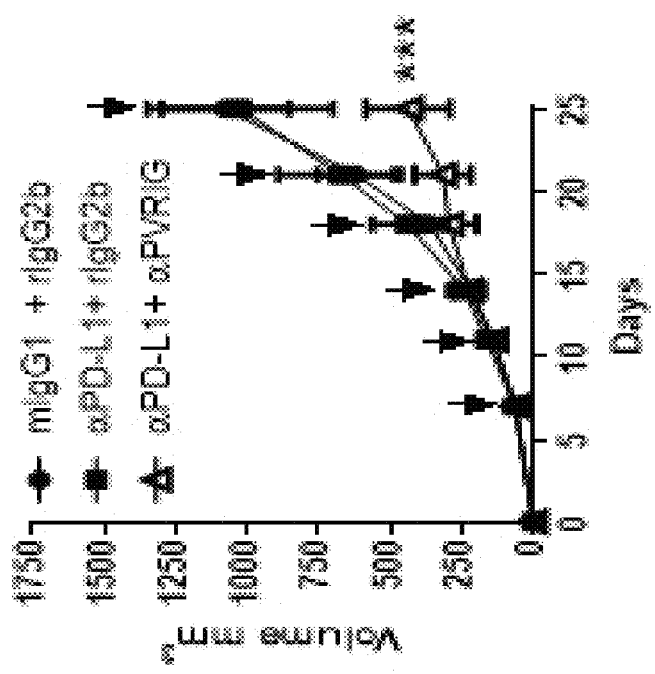

Anti-mPVRIG Antibody Inhibited Tumor Growth in Combination with PD-1 Antibody or TIGIT Deficiency After demonstrating that genetic deficiency of PVRIG resulted in reduced tumor growth, we next aimed to demonstrate that antibody-mediated inhibition of PVRIG- PVRL2 interaction could improve anti-tumor immunity, in particular in combination with PD1 or TIGIT inhibitors as our human in vitro data has demonstrated. To assess this, we generated a high affinity, antagonistic anti-mPVRIG antibody. Affinity assessments of anti-mPVRIG mAb determined by FACS showed sub-nano-molar Kd (0.33 nM on HEK293 mPVRIG, 0.39 nM on D10.G4.1 cells), similar to CHA.7.518.1.H4(S241P) (FIG. 95G-H). The specificity of this antibody was further confirmed as the majority of binding to D10.G4.1 cells was abrogated upon mPVRIG knockdown (FIG. 95I). Anti-mPVRIG was tested for disrupting mPVRIG-mPVRL2 interaction by inhibiting the binding of mPVRIG Fc to B16F10 and the binding of mPVRL2 Fc to mPVRIG-overexpressing HEK293 cells (FIG. 89A). Complete blocking of PVRIG-PVRL2 interaction by anti-mPVRIG antibody was observed in both assay formats (FIG. 89A, FIG. 95J), demonstrating an antagonistic anti-mPVRIG antibody. Next, we tested the in vivo efficacy of mPVRIG blockade in a syngeneic CT26 subcutaneous colon tumor model. PVRIG expression was elevated on NK and T cells in the tumor microenvironment, compared to corresponding splenic or draining lymph node subsets (FIG. 89B). Treating tumor bearing mice with anti-mPVRIG blocking mAb as monotherapy failed to reduce tumor growth (data not shown). However, combination of anti-PVRIG and anti-PD-L1 mAbs effectively delayed CT26 tumor growth (FIG. 89C) and increased significantly the survival of treated mice with 40% rate of complete responders (FIG. 89D). Consistent with our human T cell assay data, these data demonstrate that combination of PD-1 and PVRIG inhibitors can reduce tumor growth.

Figure 89E:
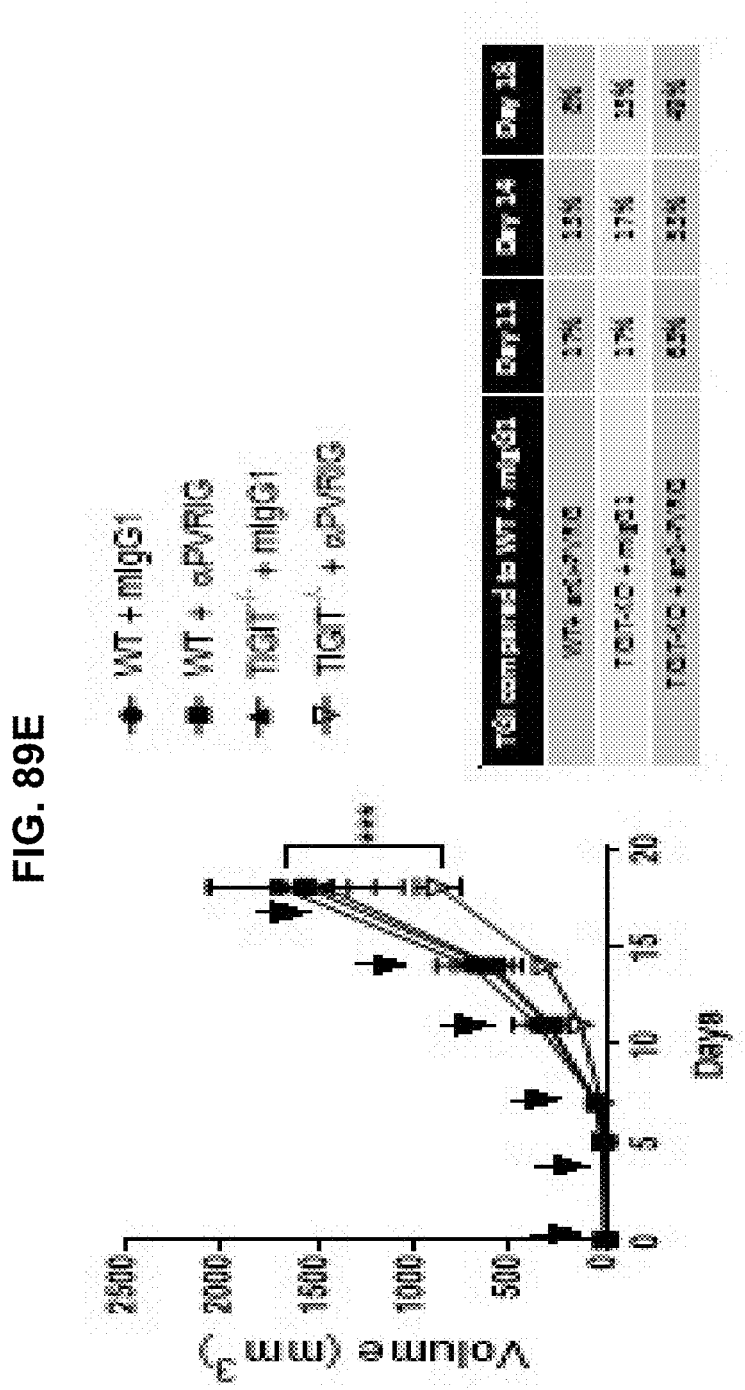
Figure 89F:
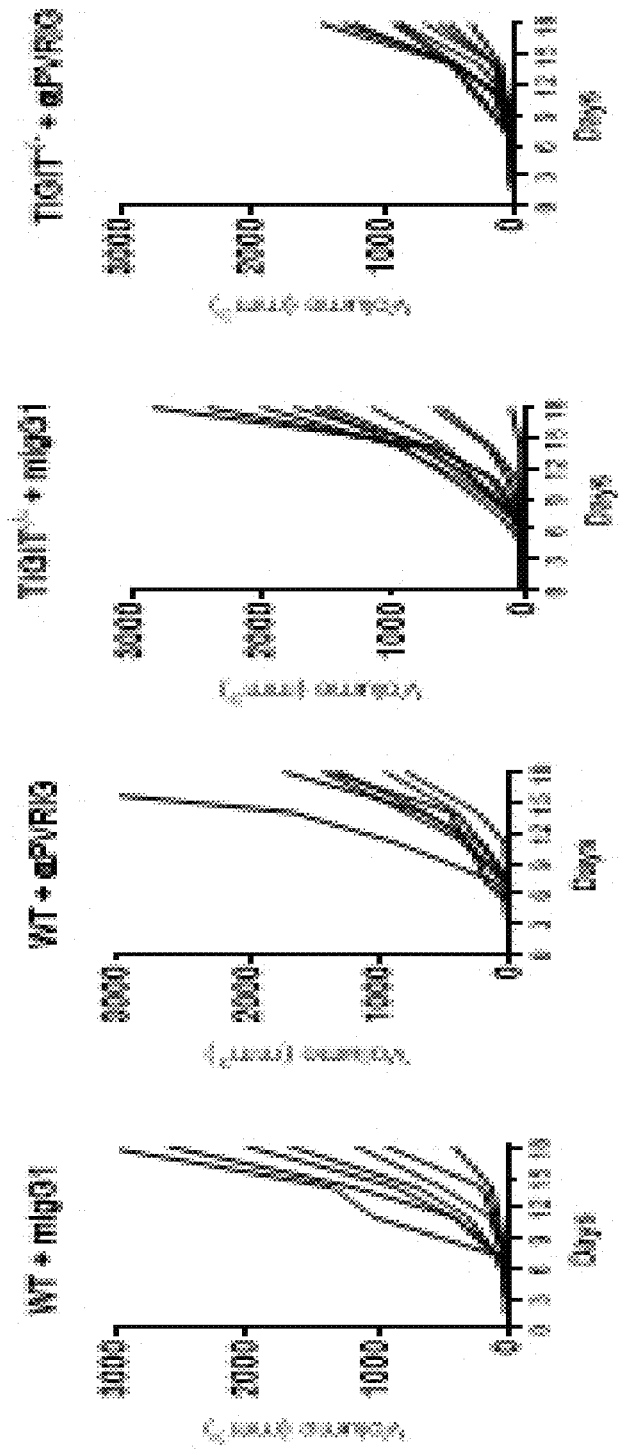

We also tested the effect of ablating both PVRIG and TIGIT signaling in regulating anti-tumor responses. For these studies, we tested the efficacy of anti-mPVRIG antibody in either WT or TIGIT$^{-/-}$ mice inoculated with B16F10/Db-hmgp100 melanoma cells. Treatment of tumor bearing WT mice with anti-mPVRIG blocking mAb had minor effect compared to isotype treatment (17% TGI at day 11 and 8% TGI at endpoint, day 18). The effect of TIGIT deletion on tumor growth was minor as well, compared to WT control group (17% TGI at day 11 and 13% TGI at endpoint). However, when TIGIT deletion was combined with anti-PVRIG mAb treatment, a significant tumor growth inhibition was observed (63% at day 11 and 49% TGI at endpoint (FIG. 89E, F). In accordance to tumor growth inhibition, TIGIT$^{-/-}$ mice treated with anti-PVRIG mAb 407 exhibited increased survival compared to WT control group, however, statistical significance was not achieved in this aggressive rapidly growing tumor model (data not shown). Taken together, these data demonstrate synergistic activity of PVRIG inhibitors with PD1 or TIGIT inhibitors and are in accordance with our human functional data providing the rationale for clinical testing of CHA.7.518.1.H4(S241P) with PD1 or TIGIT inhibitors.

Discussion

Although antibodies targeting immune T cell checkpoints such as CTLA4 and PD-1 have increased cancer patient survival, the majority of cancer patients still do not display clinical benefit. One possible reason for this is the presence of additional T cell regulators that inhibit T cell anti-tumor immunity. Here, we elucidated the role of PVRIG in regulating effector T cell function and demonstrate that PVRIG antagonism increases T cell anti-tumor responses and reduces tumor growth.

PVRIG is a novel member of the nectin and nectin like family, placing it among several known immunoregulatory receptors in the family. Understanding the interplay of the receptors within this family is crucial to understanding the relevance and mechanism of action of PVRIG. Of these receptors, DNAM, TIGIT, and CD96 are most closely related to PVRIG in terms of sharing the same ligands, PVR and PVRL2. DNAM binds to both PVR and PVRL2 and delivers a costimulatory signal to lymphocytes. TIGIT is reported to bind to PVR and weakly to PVRL2. We were unable to detect an interaction between TIGIT and PVRL2 using ELISA or SPR (data not shown), suggesting that PVR is the dominant ligand for TIGIT. Using similar methods, we and a recent report detected a high affinity interaction between PVRL2 and PVRIG, suggesting that PVRIG is the dominant inhibitory receptor to PVRL2. These data suggest that TIGIT and PVRIG comprise dual signaling nodes in this axis and that blocking both is needed for maximal increase of T cell activation within this family. In addition to interacting with different ligands, we observed that PVRIG has the highest expression on effector or memory T cells, similar to PD-1 whereas TIGIT has the highest expression on regulatory T cells. Furthermore, we observed that PVRIG displayed late induction after T cell activation as compared to TIGIT. These data suggest that PVRIG has a unique role within this family, interacting with high affinity to PVRL2 and having a differentiated expression on memory cells and a late induction profile to TIGIT.

Reported here is the novel role of PVRIG in regulating anti-tumor T cell responses using PVRIG deficient mice and antagonistic anti-PVRIG antibodies. It was demonstrated here that mouse PVRIG was expressed on T cells and NK cells, induced upon lymphocyte activation, and is highest in the TME as compared to the periphery. Furthermore, we show that PVRIG deficiency led to increased T cell function in-vitro and reduced tumor growth in-vivo. An antagonistic antibody to PVRIG reduced tumor growth when combined with anti-PD-L1 or genetic deficiency of TIGIT, demonstrating a necessary role of PVRIG in regulating T cell responses. These novel data provide in vivo proof of concept using preclinical tumor models that targeting PVRIG in combination with PD1 or TIGIT antagonism is a potential novel therapy for the treatment of cancers.

Reported here on a high affinity anti-human PVRIG antibody that disrupts the interaction of PVRIG and PVRL2 which we are pursuing for testing in clinical trials. To determine potential cancer indications that could inform on patient selection in clinical trials, we examined the expression profile of this axis in human cancers by FACS and IHC. For PVRIG, we observed that the mean expression of PVRIG on CD4 and CD8 T cells by FACS highest in endometrial, lung, kidney, and ovarian cancers, although this difference did not achieve statistical difference with other cancer types as determined by ANOVA with a Tukey's multiple comparison test with the current number of samples. As PVRIG is induced upon T cell activation and given that the majority of tumor infiltrating T cells are antigen experienced, it is perhaps not surprising that the median PVRIG expression was similar across tumor samples and cancer types. We observed that PVRIG expression was correlated with PD-1 and TIGIT expression, suggesting that the interplay of these 3 inhibitory receptors will be important in regulating the anti-tumor response. In this report, we observed a synergistic increase in T cell function when PVRIG antibodies were combined with TIGIT antibodies in a CD8 T cell tumor cell co-culture, better than PD-1 in combination with PVRIG or TIGIT inhibitors. These data, along with a previous study demonstrating a role for PVRIG and TIGIT in regulating DC-T cell interactions, show that this pathway could be involved in regulating T cell-APC and T cell-tumor cell interactions, and provide multiple mechanisms by which targeting PVRIG could increase the anti-tumor immune response.

As expression of PD-L1 has been correlated with clinical response to PD-1 inhibitors, we also analyzed PVRL2 expression in tumors by FACS and IHC to assess whether certain cancer types have higher expression. Assessing dissociated tumor cells, we observed that mean PVRL2 expression on macrophages from endometrial, head & neck, kidney, lung, and ovarian samples were higher when compared to other tumor types. Mean PVRL2 expression on CD45$^-$ non immune cells was higher on breast, colorectal, endometrial, lung, ovarian, and prostate cancers compared to other cancers. Based on the PVRIG and PVRL2 expression, we determined that endometrial, head & neck, lung, kidney, and ovarian cancers have a greater incidence of tumors with high PVRIG and PVRL2 expression and that these are potential cancers that could response to inhibitors of this pathway.

It was observed here that PVRL2 expression can be modulated on antigen producing cells in vitro by inflammatory mediators whereas PVRL2 expression on cancer cells was not altered. These data suggest that PVRL2 expression on antigen presenting cells can be regulated by inflammation and could be an indicator of an inflamed tumor. Indeed, we did observe that all PD-L1+ tumors also express PVRL2, both on the tumor cells and in the immune compartment. Expression of PVRL2 on myeloid cells could help predict responses to PVRIG inhibitors in a combination setting with PD-1 or TIGIT to further enhance the anti-tumor effect. Interestingly, a portion of PD-L1 negative tumors also expressed PVRL2, primarily on the tumor cells and not on the immune cells. PVR and PVRL2 expression on epithelial cells is reported to be induced in tumorigenesis, as well as in response to stress and DNA damage. These data are consistent with in vitro findings that the regulation of PVRL2 expression on tumor cells is not dependent on IFN-g. As PD-L1 is induced in an adaptive resistance setting in response to IFN-g and is associated with an inflammatory response, the expression of PVRL2 in the absence of PD-L1 suggests that PVRL2 expression is more prevalent than PD-L1 and that PVRL2 is expressed in non-inflamed tumors. Based on the above, it is possible that the presence of PVR and PVRL2 contribute to suppressing immune responses independently of PD-L1 and that inhibitors of PVRIG and TIGIT could be of particular importance in patients that are PD-L1 negative or non-responders/progressors to PD-1 inhibitors.

In summary, this report provides several novel insights into PVRIG biology, including characterizing the expression of this axis in human cancers, demonstrating a prominent role for PVRIG/TIGIT in regulating the CD8-tumor cell interaction, and showing that PVRIG antagonism in combination with PD-1 inhibition or TIGIT deficiency lead to a synergistic reduction in tumor growth. These data extend our current understanding of PVRIG biology and provide rationale for clinical testing of CHA.7.518.1.H4(S241P), a high affinity anti-PVRIG antibody, in patients with cancer.

REFERENCES

1. Hanahan D, Weinberg R A. The hallmarks of cancer. Cell 2000; 100(1):57-70.
2. Hanahan D, Weinberg R A. Hallmarks of cancer: the next generation. Cell 2011; 144(5):646-74 doi 10.1016/j.cell.2011.02.013.
3. Galon J, Mlecnik B, Bindea G, Angell H K, Berger A, Lagorce C, et al. Towards the introduction of the 'Immunoscore' in the classification of malignant tumours. J Pathol 2014; 232(2):199-209 doi 10.1002/path.4287.
4. Zitvogel L, Galluzzi L, Smyth M J, Kroemer G. Mechanism of action of conventional and targeted anticancer therapies: reinstating immunosurveillance. Immunity 2013; 39(1):74-88 doi 10.1016/j.immuni.2013.06.014.
5. Danilova L, Wang H, Sunshine J, Kaunitz G J, Cottrell T R, Xu H, et al. Association of PD-1/PD-L axis expression with cytolytic activity, mutational load, and prognosis in melanoma and other solid tumors. Proc Natl Acad Sci USA 2016; 113(48):E7769-E77 doi 10.1073/pnas.1607836113.
6. Topalian S L, Taube J M, Anders R A, Pardoll D M. Mechanism-driven biomarkers to guide immune checkpoint blockade in cancer therapy. Nat Rev Cancer 2016; 16(5):275-87 doi 10.1038/nrc.2016.36.
7. Zarour H M. Reversing T-cell Dysfunction and Exhaustion in Cancer. Clin Cancer Res 2016; 22(8):1856-64 doi 10.1158/1078-0432.CCR-15-1849.
8. Pardoll D M. The blockade of immune checkpoints in cancer immunotherapy. Nat Rev Cancer 2012; 12(4):252-64 doi 10.1038/nrc3239.
9. Sharma P, Allison J P. Immune checkpoint targeting in cancer therapy: toward combination strategies with curative potential. Cell 2015; 161(2):205-14 doi 10.1016/j.cell.2015.03.030.
10. Cha E, Klinger M, Hou Y, Cummings C, Ribas A, Faham M, et al. Improved survival with T cell clonotype stability after anti-CTLA-4 treatment in cancer patients. Sci Transl Med 2014; 6(238):238ra70 doi 10.1126/scitranslmed.3008211.
11. Robert L, Tsoi J, Wang X, Emerson R, Homet B, Chodon T, et al. CTLA4 blockade broadens the peripheral T-cell receptor repertoire. Clin Cancer Res 2014; 20(9):2424-32 doi 10.1158/1078-0432.CCR-13-2648.
12. Tumeh P C, Harview C L, Yearley J H, Shintaku I P, Taylor E J, Robert L, et al. PD-1 blockade induces responses by inhibiting adaptive immune resistance. Nature 2014; 515(7528):568-71 doi 10.1038/nature13954.
13. Chan C J, Andrews D M, Smyth M J. Receptors that interact with nectin and nectin-like proteins in the immunosurveillance and immunotherapy of cancer. Curr Opin Immunol 2012; 24(2):246-51 doi 10.1016/j.coi.2012.01.009.
14. Martinet L, Smyth M J. Balancing natural killer cell activation through paired receptors. Nat Rev Immunol 2015; 15(4):243-54 doi 10.1038/nri3799.
15. Zhu Y, Paniccia A, Schulick A C, Chen W, Koenig M R, Byers J T, et al. Identification of CD112R as a novel checkpoint for human T cells. J Exp Med 2016; 213(2): 167-76 doi 10.1084/jem.20150785.
16. Bottino C, Castriconi R, Pende D, Rivera P, Nanni M, Carnemolla B, et al. Identification of PVR (CD155) and Nectin-2 (CD112) as cell surface ligands for the human DNAM-1 (CD226) activating molecule. J Exp Med 2003; 198(4):557-67 doi 10.1084/jem.20030788.
17. Yu X, Harden K, Gonzalez L C, Francesco M, Chiang E, Irving B, et al. The surface protein TIGIT suppresses T cell activation by promoting the generation of mature immunoregulatory dendritic cells. Nat Immunol 2009; 10(448-57 doi 10.1038/ni.1674.
18. Stanietsky N, Simic H, Arapovic J, Toporik A, Levy O, Novik A, et al. The interaction of TIGIT with PVR and PVRL2 inhibits human NK cell cytotoxicity. Proc Natl Acad Sci USA 2009; 106(42):17858-63 doi 10.1073/pnas.0903474106.
19. Johnston R J, Comps-Agrar L, Hackney J, Yu X, Huseni M, Yang Y, et al. The immunoreceptor TIGIT regulates antitumor and antiviral CD8(+) T cell effector function. Cancer Cell 2014; 26(6):923-37 doi 10.1016/j.ccell.2014.10.018.
20. Zhang B, Zhao W, Li H, Chen Y, Tian H, Li L, et al. Immunoreceptor TIGIT inhibits the cytotoxicity of human cytokine-induced killer cells by interacting with CD155. Cancer Immunol Immunother 2016; 65(3):305-14 doi 10.1007/s00262-016-1799-4.
21. Chan C J, Martinet L, Gilfillan S, Souza-Fonseca-Guimaraes F, Chow M T, Town L, et al. The receptors CD96 and CD226 oppose each other in the regulation of natural killer cell functions. Nat Immunol 2014; 15(5): 431-8 doi 10.1038/ni.2850.
22. Fuchs A, Cella M, Giurisato E, Shaw A S, Colonna M. Cutting edge: CD96 (tactile) promotes NK cell-target cell adhesion by interacting with the poliovirus receptor (CD155). J Immunol 2004; 172(7):3994-8.
23. Machlenkin A, Uzana R, Frankenburg S, Eisenberg G, Eisenbach L, Pitcovski J, et al. Capture of tumor cell membranes by trogocytosis facilitates detection and isolation of tumor-specific functional CTLs. Cancer Res 2008; 68(6):2006-13 doi 10.1158/0008-5472.CAN-07-3119.
24. Ohtani H, Nakajima T, Akari H, Ishida T, Kimura A. Molecular evolution of immunoglobulin superfamily genes in primates. Immunogenetics 2011; 63(7):417-28 doi 10.1007/s00251-011-0519-7.
25. Taube J M, Anders R A, Young G D, Xu H, Sharma R, McMiller T L, et al. Colocalization of inflammatory response with B7-h1 expression in human melanocytic lesions supports an adaptive resistance mechanism of immune escape. Sci Transl Med 2012; 4(127):127ra37 doi 10.1126/scitranslmed.3003689.
26. Cerboni C, Fionda C, Soriani A, Zingoni A, Doria M, Cippitelli M, et al. The DNA Damage Response: A Common Pathway in the Regulation of NKG2D and DNAM-1 Ligand Expression in Normal, Infected, and Cancer Cells. Front Immunol 2014; 4:508 doi 10.3389/fimmu.2013.00508.
27. de Andrade L F, Smyth M J, Martinet L. DNAM-1 control of natural killer cells functions through nectin and nectin-like proteins. Immunol Cell Biol 2014; 92(3):237-44 doi 10.1038/icb.2013.95.
28. Overwijk W W, Tsung A, Irvine K R, Parkhurst M R, Goletz T J, Tsung K, et al. gp100/pmel 17 is a murine tumor rejection antigen: induction of "self"-reactive, tumoricidal T cells using high-affinity, altered peptide ligand. J Exp Med 1998; 188(2):277-86.

S. Example 19: Tumor Cell Killing Assay

The effect of an anti-human TIGIT antibody and CHA.7.518.1.H4(S241P), either alone or in combination, on tumor cell killing was assessed by an in vitro co-culture assay with human CMV-specific CD8$^+$ T cells. The HLA-A2$^+$ target cell lines used in the assay were the melanoma cell line, Mel624, which stably expresses human PVR and PVRL2, and the pancreatic adenocarcinoma cell line, Panc05.04, which expresses endogenous levels of human PVR and PVRL2. Both tumor cell lines were stably transduced with a luciferase reporter gene through lentiviral transduction (System Biosciences). Mel624 and Panc05.04 cells were pulsed with the CMV pp65 peptide at 0.0033 μg/ml or 0.01 μg/ml at 37° C. for 1 hour, respectively. Cells were then washed and plated at 20,000 cells/well. A benchmark anti-human TIGIT antibody and CHA.7.518.1.H4 (S241P) were added to the culture in combination, or with a control hIgG4 isotype antibody at 10 μg/ml. Human CMV-specific CD8$^+$ T cells from three different donors, specified as Donor 4, Donor 72, and Donor 234 were added at 100,000 cells/well. Co-cultures were incubated at 37° C. for 16 hours. After the incubation, plates were removed from the incubator and allowed to equilibrate to room temperature for 30 minutes. Bio-Glo luciferase substrate (Promega) was added to each well and the mixture equilibrated for 10 minutes at room temperature protected from light. Luminesce or relative light units (RLU) was quantified on an EnVision multi-label reader (Perkin Elmer) with an ultrasensitive luminescence detector. Percent specific killing was calculated by [(RLU for treatment antibody−RLU for medium alone)/RLU for medium alone]×100.

Results

FIGS. 99A and B show the effect of the anti-TIGIT antibody and CHA.7.518.1.H4(S241P) treatment on killing of the Mel624 and Panc05.04 cells, respectively. When added to the co-culture alone, both the anti-TIGIT antibody and CHA.7.518.1.H4(S241P) induced significant T cell killing of the tumor cell lines compared to the isotype control antibody. For the anti-TIGIT antibody the percent specific killing ranged from 19-41% for the Mel624 cells, and 3-44% for the Panc05.04 cells across the 3 different CMV-reactive donors tested. For CHA.7.518.1.H4(S241P), the percent specific killing ranged from 16-20% for the Mel624 cells, and 0.21-29% for the Panc05.04 cells. In some cases, an additive effect on tumor cell killing was observed in the combined treatment of the anti-TIGIT antibody and CHA.7.518.1.H4(S241P).

To determine whether the effect of an anti-TIGIT antibody and CHA.7.518.1.H4(S241P) on tumor cell killing was dose-dependent, the assay was carried out with a 10 point, 2-fold dilution series for each antibody starting at 0.5 μg/ml for the anti-TIGIT antibodies, and 10 μg/ml for CHA.7.518.1.H4(S241P) (FIG. 100). Mel624 killing decreased in a dose-dependent manner when either anti-TIGIT antibody, BM26 or CPA.9.086, were combined with CHA.7.518.1.H4(S241P). More potent killing was observed for the CPA.9.086 and CHA.7.518.1.H4(S241P) combination with an EC$_{50}$ of 0.40±0.49 nM, compared to the BM26 and CHA.7.518.1.H4(S241P) combination with an EC$_{50}$ of 2.6±1.7 nM.

T. Example 20: Biophysical Measurement of K$_D$

KinExA equilibrium experiments were performed using a KinExA 3200 instrument (Sapidyne Instruments, Boise, Id., USA) at 22° C. Recombinant His-tagged human TIGIT was obtained from Sino Biologicals (Beijing, China) and reconstituted into 1×PBS. All antigen and antibody samples for KinExA analyses were prepared in degassed PBST buffer (PBS with 0.05% tween 20) with 100 μg/mL filtered BSA and 0.02% sodium azide. The secondary detection antibody used was Alexa Flour 647-labeled goat anti-human IgG (H+L) (Jackson ImmunoResearch Laboratories) diluted 400- to 700-fold in the PBST buffer (with BSA and azide) described above from a 0.5 mg/mL stock in 1×PBS, pH 7.4. For each KinExA experiment, ~20 μg of human TIGIT was diluted into 1 mL of 50 mM sodium carbonate, pH 9.2 which was added directly to 50 mg of azlactone beads (Ultralink Support, Thermo Scientific, Rockford, Ill., USA) and rocked overnight at 4° C. After rocking, the beads were rinsed once with 1 M Tris buffer, pH 8.5, containing 10 mg/mL BSA and rocked for one hour at room temperature in the same buffer. Coupled beads were added to the bead reservoir in the KinExA instrument and diluted to ~30 mL with 1×HBS-N (0.01 M Hepes, 0.15M NaCl, GE Healthcare) containing 0.02% sodium azide which was also the running buffer for the KinExA instrument. All antigen-coupled beads were used immediately after preparation.

For two replicate measurements of $K_D$ for CPA.9.086 (Table 1), 14 concentrations of TIGIT ranging from 957 aM-212 pM were equilibrated at room temperature for ~72 hours with 2.5 pM CPA.9.086 binding sites and 1.8 pM CPA.9.086 binding sites. For CPA.9.083, 14 concentrations of TIGIT ranging from 478 aM-196 pM were equilibrated for ~72 hours with 1.8 pM CPA.9.083 binding sites. For duplicate measurements of the benchmark antibody, BM26 hIgG4, 14 concentrations of TIGIT ranging from 9.6 fM-3.53 nM were equilibrated for ~72 hours with 20 pM BM26 binding sites and 8.0 pM BM26 binding sites. For CHA.9.547.13, 14 concentrations of TIGIT ranging from 10.5 fM-2.2 nM were equilibrated for ~72 hours with 8 pM mAb CHA.9.547.13 binding sites. The volume flowed through the bead pack for each equilibrated sample for all experiments ranged from 4 mL to 11 mL at a flow rate of 0.25 mL/min. Data were fit with a 1:1 "standard equilibrium" binding model using KinExA Pro software (Version 4.2.10; Sapidyne Instruments) to estimate $K_D$ and generate the 95% confidence interval (CI) of the curve fit.

Results

Both CPA.9.083 and CPA.9.086 bound to human TIGIT with femtomolar binding affinity, while CHA.9.547.13 and BM26 bound with picomolar affinity. Thus, CPA.9.083 and CPA.9.086 bound to human TIGIT with the highest affinity of the four different antibodies tested.

TABLE 1

$K_D$ measurements of anti-human TIGIT hIgG4 antibodies determined by KinExA

| Antibody | $K_D$ ± 95% CI (n = 1) | $K_D$ ± 95% CI (n = 2) |
|---|---|---|
| CHA.9.547.13 | 18.8 ± 5.8 pM | Not determined |
| CPA.9.083 | 694 ± 277 fM | Not determined |
| CPA.9.086 | 553 ± 230 fM | 665 ± 378 fM |
| BM26 | 8.2 ± 2.8 pM | 11.2 ± 3.6 pM |

U. Example 21: Development and Functional Characterization of CPA.9.086, a Novel Therapeutic Antibody Targeting the Immune Checkpoint TIGIT Background: TIGIT is a coinhibitory receptor that is highly expressed on lymphocytes, including effector and regulatory CD4+ T cells (Tregs), effector CD8+ T cells, and NK cells, that infiltrate different types of tumors. Engagement of TIGIT with its reported ligands, poliovirus receptor (PVR) and PVR-like proteins (PVRL2 and PVRL3) directly suppresses lymphocyte activation. PVR is also broadly expressed in tumors, suggesting that the TIGIT-PVR signaling axis may be a dominant immune escape mechanism for cancer. We report here the biophysical and functional characterization of CPA.9.086, a therapeutic antibody targeting TIGIT. We also demonstrate that co-blockade of TIGIT and a new checkpoint inhibitor, PVRIG, augments T cell responses.

Materials and Methods: Human phage display and mouse hybridoma antibody discovery campaigns were conducted to generate therapeutic anti-TIGIT antibodies. The resulting antibodies were evaluated for their ability to bind to recombinant and cell surface-expressed human TIGIT with high affinity. Cross-reactivity of the antibodies to cynomolgus macaque and mouse TIGIT was also examined. A subset of antibodies that bound with high affinity to human TIGIT, and cross-reactive to cynomolgus TIGIT were further characterized for their ability to block the interaction between TIGIT and PVR. Blocking antibodies were screened for their ability to enhance antigen-specific T cell activation in vitro either alone, or in combination with an anti-PVRIG antibody, CHA.7.518.1.H4(S241P).

Results: A lead antibody, CPA.9.086, was identified that binds to human TIGIT with high femtomolar affinity. This antibody bound to TIGIT endogenously expressed on human CD8+ T cells with higher affinity than tested benchmark antibodies, and was also cross-reactive to both cynomolgus and mouse TIGIT. When tested for in vitro activity, CPA.9.086 augmented cytokine secretion and tumor cell killing by CMV-specific CD8+ T cells with superior or equivalent potency to the tested benchmark antibodies. Combination of CPA.9.086 with an anti-PD1 antibody or CHA.7.518.1.H4(S241P) resulted in enhanced CMV-specific CD8+ T cell activity. Furthermore, we demonstrated that TIGIT is predominantly expressed on Tregs and effector CD8+ T cells from solid tumors compared to peripheral blood, suggesting that these populations will likely be preferentially targeted by CPA.9.086.

Conclusion: The development of a very high affinity antagonistic TIGIT antibody, CPA.9.086, that is currently in preclinical development is described. We postulate that the femtomolar affinity of CPA.9.086 could result in lower and less frequent dosing in patients. CPA.9.086 can enhance human T cell activation either alone or in combination with other checkpoint antibodies. Thus, this data demonstrates the utility of targeting TIGIT, PD1, and PVRIG for the treatment of cancer.

SEQUENCE LISTING (612 sequences)

SEQ ID NO: 1 - protein, 204 aa, Artificial Sequence
  Human PVRIG sequence starting from position 21
MGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADLAGILGVSGVLLFGCVYLLHLLRRHKHRPAPRLQPSRTSPQAPRARAWAPSQA

SEQ ID NO: 2 - protein, 224 aa, Artificial Sequence
  Human PVRIG sequence starting from position 1
MRTEAQVPALQPPEPGLEGAMGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADLAGILGVSGVLLFGCVYLLHLLRRHKHRPAPRLQPSRTSPQAPRARAWAPSQA

SEQ ID NO: 3 - protein, 479 aa, Artificial Sequence
  Human PVLR2 alpha isoform
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPRASPRDVGPLVWGAVGGTLLVLLLLAGGSLAFILLRVRRRRKSPGGAGGGASGDGGFYDPKAQVLGNGDPVFWTPVVPGPMEPDGKDEEEEEEEEKAEKGLMLPPPPALEDDMESQLDGSLISRRAVYV

SEQ ID NO: 4 - protein, 518 aa, Artificial Sequence
  Human PVLR2 delta isoform
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSY

SEQ ID NO: 5 - protein, 120 aa, Artificial Sequence
  Variable heavy (vh) domain
QVQLVQSGAEVKKPGASVKVSCKASGYTFTDYNINWVRQAPGQGLEWMGYIYPYIGGSGYAQKFQGRVTMTRDTSTSTVYMELSSLRSEDTAVYYCAREDKTARNAMDYWGQGTLVTVSS

SEQ ID NO: 6 - protein, 8 aa, Artificial Sequence
  vhCDR1
GYTFTDYN

SEQ ID NO: 7 - protein, 8 aa, Artificial Sequence
  vhCDR2
IYPYIGGS

SEQ ID NO: 8 - protein, 13 aa, Artificial Sequence
  vhCDR3
AREDKTARNAMDY

SEQ ID NO: 9 - protein, 447 aa, Artificial Sequence
  Full length HC
QVQLVQSGAEVKKPGASVKVSCKASGYTFTDYNINWVRQAPGQGLEWMGYIYPYIGGSGYAQKFQGRVTMTRDTSTSTVYMELSSLRSEDTAVYYCAREDKTARNAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 10 - protein, 107 aa, Artificial Sequence
  Variable light (vl) domain
DIQMTQSPSSLSASVGDRVTITCRVSENIYSNLAWYQQKPGKAPKLLIYEATNLAEGVPSRFSGSGSGTDFTLTISSLQPEDFATYYCQHFWGTPYTFGQGTKLEIK

SEQ ID NO: 11 - protein, 6 aa, Artificial Sequence
  vlCDR1
ENIYSN

SEQ ID NO: 12 - protein, 3 aa, Artificial Sequence
  vlCDR2
EAT

SEQ ID NO: 13 - protein, 9 aa, Artificial Sequence
  vlCDR3
QHFWGTPYT

SEQ ID NO: 14 - protein, 214 aa, Artificial Sequence
  Full length light chain
DIQMTQSPSSLSASVGDRVTITCRVSENIYSNLAWYQQKPGKAPKLLIYEATNLAEGVPSRFSGSGSGTDFTLTISSLQPEDFATYYCQHFWGTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15 - protein, 119 aa, Artificial Sequence
  Variable heavy (vh) domain
QVQLVQSGAEVKKPGASVKVSCKASGYAFTNYLIEWVRQAPGQGLEWIGVINPGSGGIYYAQKFQGRVTMTADTSTSTVYMELSSLRSEDTAVYYCARSETHDTWFAYWGQGTLVTVSS

SEQ ID NO: 16 - protein, 8 aa, Artificial Sequence
  vhCDR1
GYAFTNYL

SEQ ID NO: 17 - protein, 8 aa, Artificial Sequence
  vhCDR2
INPGSGGI

SEQ ID NO: 18 - protein, 12 aa, Artificial Sequence
  vhCDR3
ARSETHDTWFAY

SEQ ID NO: 19 - protein, 446 aa, Artificial Sequence
  Full length HC
QVQLVQSGAEVKKPGASVKVSCKASGYAFTNYLIEWVRQAPGQGLEWIGVINPGSGGIYYAQKFQGRVTMTADTSTSTVYMELSSLRSEDTAVYYCARSETHDTWFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 20 - protein, 107 aa, Artificial Sequence
  Variable light (vl) domain
DIQMTQSPSSLSASVGDRVTITCKASQSVRIAVAWFQQKPGKAPKALIYLASTRHTGVPSRFSGSGSGTDFTLTISSVQPEDFATYYCLQHWNYPYTFGQGTKLEIK

SEQ ID NO: 21 - protein, 6 aa, Artificial Sequence
  vlCDR1
QSVRIA

SEQ ID NO: 22 - protein, 3 aa, Artificial Sequence
  vlCDR2
LAS

SEQ ID NO: 23 - protein, 9 aa, Artificial Sequence
  vlCDR3
LQHWNYPYT

SEQ ID NO: 24 - protein, 214 aa, Artificial Sequence
  Full length light chain
DIQMTQSPSSLSASVGDRVTITCKASQSVRIAVAWFQQKPGKAPKALIYLASTRHTGVPSRFSGSGSGTDFTLTISSVQPEDFATYYCLQHWNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25 - protein, 96 aa, Artificial Sequence
  Humanized sequences of CHA.7.518 antibody VH
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYC

SEQ ID NO: 26 - protein, 15 aa, Artificial Sequence
  Humanized sequences of CHA.7.518 antibody VH
YFDYWGQGTLVTVSS

SEQ ID NO: 27 - protein, 120 aa, Artificial Sequence
  Humanized sequences of CHA.7.518 antibody VH
  MOD_RES (33)..(33): Asn, Gln, Ser or Ala
  MOD_RES (105)..(105): Asn, Gln, Ser or Ala
EVQLQQSGPELVKPGASVKISCKASGYTFTDYXINWVKQSHGKSLEWIGYIYPYIGGSGYNQKFKSKATLSADNPSSTAYMELRSLTSEDSAVYYCAREDKTARXAMDYWGQGTPVTVSS

SEQ ID NO: 28 - protein, 98 aa, Artificial Sequence
  Humanized sequences of CHA.7.518 antibody VH
  MOD_RES (33)..(33): Tyr, Gln, Ser or Ala
QVQLVQSGAEVKKPGASVKVSCKASGYTFTSYXMHWVRQAPGQGLEWMGIINPSGGSTSYAQKFQGRVTMTRDTSTSTVYMELSSLRSEDTAVYYCAR

SEQ ID NO: 29 - protein, 120 aa, Artificial Sequence
  Humanized sequences of CHA.7.518 antibody VH
  MOD_RES (33)..(33): Asn, Gln, Ser or Ala
  MOD_RES (105)..(105): Asn, Gln, Ser or Ala
QVQLVQSGAEVKKPGASVKVSCKASGYTFTDYXINWVRQAPGQGLEWMGYIYPYIGGSGYAQKFQGRVTMTRDTSTSTVYMELSSLRSEDTAVYYCAREDKTARXAMDYWGQGTLVTVSS

SEQ ID NO: 30 - protein, 120 aa, Artificial Sequence
  Humanized sequences of CHA.7.518 antibody VH
  MOD_RES (33)..(33): Asn, Gln, Ser or Ala
  MOD_RES (105)..(105): Asn, Gln, Ser or Ala
QVQLVQSGAEVKKPGASVKVSCKASGYTFTDYXINWVRQAPGQGLEWIGYIYPYIGGSGYAQKFQGRVTMTADTSTSTVYMELSSLRSEDTAVYYCAREDKTARXAMDYWGQGTLVTVSS

SEQ ID NO: 31 - protein, 120 aa, Artificial Sequence
  Humanized sequences of CHA.7.518 antibody VH
  MOD_RES (33)..(33): Asn, Gln, Ser or Ala
  MOD_RES (105)..(105): Asn, Gln, Ser or Ala
QVQLVQSGAEVKKPGASVKISCKASGYTFTDYXINWVRQAPGQGLEWIGYIYPYIGGSGYAQKFQGRATLTADTSTSTAYMELSSLRSEDTAVYYCAREDKTARXAMDYWGQGTLVTVSS

SEQ ID NO: 32 - protein, 120 aa, Artificial Sequence
  Humanized sequences of CHA.7.518 antibody VH
  MOD_RES (33)..(33): Asn, Gln, Ser or Ala
  MOD_RES (105)..(105): Asn, Gln, Ser or Ala
QVQLVQSGAEVKKPGASVKISCKASGYTFTDYXINWVRQAPGQGLEWIGYIYPYIGGSGYAQKFQGRATLTADNSTSTAYMELSSLRSEDTAVYYCAREDKTARXAMDYWGQGTLVTVSS

SEQ ID NO: 33 - protein, 96 aa, Artificial Sequence
  Humanized sequences of CHA.7.518 antibody VL
DIQMTQSPSSLSASVGDRVTITCRASQSISSYLNWYQQKPGKAPKLLIYAASSLQSGVPSRFSGSGSGTDFTLTISSLQPEDFATYYCQQSYSTPP

SEQ ID NO: 34 - protein, 12 aa, Artificial Sequence
  Humanized sequences of CHA.7.518 antibody VL
YTFGQGTKLEIK

SEQ ID NO: 35 - protein, 107 aa, Artificial Sequence
  Humanized sequences of CHA.7.518 antibody VL
  MOD_RES (28)..(28): Asn, Gln, Ser, Ala or Asp
  MOD_RES (32)..(32): Asn, Gln, Ser, Ala or Asp
  MOD_RES (53)..(53): Asn, Gln, Ser, Ala or Asp
  MOD_RES (92)..(92): Trp, Tyr, Phe or His
DIQMTQSPASLSVSVGETVTIICRVSEXIYSXLAWYQQKQGKSPQLLVYEATXLAEGVPSRFSGSGSGTQYSLKINSLQSEDFGSYYCQHFXGTPYTFGGGTKLEIK

SEQ ID NO: 36 - protein, 96 aa, Artificial Sequence
  Humanized sequences of CHA.7.518 antibody VL
  MOD_RES (28)..(28): Gln, Ser, Ala or Asp
  MOD_RES (32)..(32): Tyr, Gln, Ser, Ala or Asp
  MOD_RES (53)..(53): Gln, Ser, Ala or Asp
  MOD_RES (92)..(92): Tyr, Phe or His
DIQMTQSPSSLSASVGDRVTITCRASQXISSXLNWYQQKPGKAPKLLIYAASXLQSGVPSRFSGSGSGTDFTLTISSLQPEDFATYYCQQSXSTPP

SEQ ID NO: 37 - protein, 107 aa, Artificial Sequence
  Humanized sequences of CHA.7.518 antibody VL
  MOD_RES (28)..(28): Asn, Gln, Ser, Ala or Asp
  MOD_RES (32)..(32): Asn, Gln, Ser, Ala or Asp
  MOD_RES (53)..(53): Asn, Gln, Ser, Ala or Asp
  MOD_RES (92)..(92): Trp, Tyr, Phe or His
DIQMTQSPSSLSASVGDRVTITCRVSEXIYSXLAWYQQKPGKAPKLLIYEATXLAEGVPSRFSGSGSGTDFTLTISSLQPEDFATYYCQHFXGTPYTFGQGTKLEIK

SEQ ID NO: 38 - protein, 107 aa, Artificial Sequence
  Humanized sequences of CHA.7.518 antibody VL
  MOD_RES (28)..(28): Asn, Gln, Ser, Ala or Asp
  MOD_RES (32)..(32): Asn, Gln, Ser, Ala or Asp
  MOD_RES (53)..(53): Asn, Gln, Ser, Ala or Asp
  MOD_RES (92)..(92): Trp, Tyr, Phe or His
DIQMTQSPSSLSASVGDRVTITCRVSEXIYSXLAWYQQKPGKAPKLLIYEATXLAEGVPSRFSGSGSGTDYTLTISSLQPEDFATYYCQHFXGTPYTFGQGTKLEIK

SEQ ID NO: 39 - protein, 107 aa, Artificial Sequence
  Humanized sequences of CHA.7.518 antibody VL
  MOD_RES (28)..(28): Asn, Gln, Ser, Ala or Asp
  MOD_RES (32)..(32): Asn, Gln, Ser, Ala or Asp
  MOD_RES (53)..(53): Asn, Gln, Ser, Ala or Asp
  MOD_RES (92)..(92): Trp, Tyr, Phe or His
DIQMTQSPSSLSASVGDRVTITCRVSEXIYSXLAWYQQKPGKAPKLLVYEATXLAEGVPSRFSGSGSGTDYTLTISSLQPEDFGTYYCQHFXGTPYTFGQGTKLEIK

SEQ ID NO: 40 - protein, 98 aa, Artificial Sequence
  Humanized sequences of CHA.7.538_1 antibody VH
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR

SEQ ID NO: 41 - protein, 15 aa, Artificial Sequence
  Humanized sequences of CHA.7.538_1 antibody VH
YFDYWGQGTLVTVSS

SEQ ID NO: 42 - protein, 119 aa, Artificial Sequence
  Humanized sequences of CHA.7.538_1 antibody VH
  MOD_RES (31)..(31): Asn, Gln, Ser or Ala
  MOD_RES (52)..(52): Asn, Gln, Ser or Ala
  MOD_RES (105)..(105): Trp, Tyr, Phe or His
QVQLQQSGAELVRPGASVKVSCKTSGYAFTXYLIEWVKQRPGQGLEWIGVIXPGSGGIYYNDKFKVKTTLTADKSSSTAYMQLSSLTSDDSAVYFCARSETHDTXFAYWGQGTLVTVSA

SEQ ID NO: 43 - protein, 98 aa, Artificial Sequence
  Humanized sequences of CHA.7.538_1 antibody VH
  MOD_RES (31)..(31): Gln, Ser or Ala
  MOD_RES (52)..(52): Asn, Gln, Ser or Ala
QVQLVQSGAEVKKPGASVKVSCKASGYTFTXYYMHWVRQAPGQGLEWMGIIXPSGGSTSYAQKFQGRVTMTRDTSTSTVYMELSSLRSEDTAVYYCAR

SEQ ID NO: 44 - protein, 119 aa, Artificial Sequence
  Humanized sequences of CHA.7.538_1 antibody VH
  MOD_RES (31)..(31): Asn, Gln, Ser or Ala
  MOD_RES (52)..(52): Asn, Gln, Ser or Ala
  MOD_RES (105)..(105): Trp, Tyr, Phe or His
QVQLVQSGAEVKKPGASVKVSCKASGYAFTXYLIEWVRQAPGQGLEWMGVIXPGSGGIYYAQKFQGRVTMTRDTSTSTVYMELSSLRSEDTAVYYCARSETHDTXFAYWGQGTLVTVSS

SEQ ID NO: 45 - protein, 119 aa, Artificial Sequence
  Humanized sequences of CHA.7.538_1 antibody VH
  MOD_RES (31)..(31): Asn, Gln, Ser or Ala
  MOD_RES (52)..(52): Asn, Gln, Ser or Ala
  MOD_RES (105)..(105): Trp, Tyr, Phe or His
QVQLVQSGAEVKKPGASVKVSCKASGYAFTXYLIEWVRQAPGQGLEWIGVIXPGSGGIYYAQKFQGRVTMTADTSTSTVYMELSSLRSEDTAVYYCARSETHDTXFAYWGQGTLVTVSS

SEQ ID NO: 46 - protein, 119 aa, Artificial Sequence
  Humanized sequences of CHA.7.538_1 antibody VH
  MOD_RES (31)..(31): Asn, Gln, Ser or Ala
  MOD_RES (52)..(52): Asn, Gln, Ser or Ala
  MOD_RES (105)..(105): Trp, Tyr, Phe or His
QVQLVQSGAEVKKPGASVKVSCKTSGYAFTXYLIEWVRQAPGQGLEWIGVIXPGSGGIYYAQKFQGRVTLTADTSTSTAYMELSSLRSEDTAVYYCARSETHDTXFAYWGQGTLVTVSS

SEQ ID NO: 47 - protein, 119 aa, Artificial Sequence
  Humanized sequences of CHA.7.538_1 antibody VH
  MOD_RES (31)..(31): Asn, Gln, Ser or Ala
  MOD_RES (52)..(52): Asn, Gln, Ser or Ala
  MOD_RES (105)..(105): Trp, Tyr, Phe or His
QVQLVQSGAEVKKPGASVKVSCKTSGYAFTXYLIEWVRQAPGQGLEWIGVIXPGSGGIYYAQKFQGRVTLTADKSTSTAYMELSSLRSEDTAVYYCARSETHDTXFAYWGQGTLVTVSS

SEQ ID NO: 48 - protein, 96 aa, Artificial Sequence; identical to SEQ ID NO: 33
  Humanized sequences of CHA.7.538_1 antibody VL

SEQ ID NO: 49 - protein, 12 aa, Artificial Sequence
  Humanized sequences of CHA.7.538_1 antibody VL
YTFGQGTKLEIK

SEQ ID NO: 50 - protein, 96 aa, Artificial Sequence
  Humanized sequences of CHA.7.538_1 antibody VL
DIQMTQSPSSLSASVGDRVTITCRASQGIRNDLGWYQQKPGKAPKRLIYAASSLQSGVPSRFSGSGSGTEFTLTISNLQPEDFATYYCLQHNSYPP

SEQ ID NO: 51 - protein, 107 aa, Artificial Sequence
  Humanized sequences of CHA.7.538_1 antibody VL
  MOD_RES (92)..(92): Trp, Tyr, Phe or His
  MOD_RES (93)..(93): Asn, Gln, Ser, Ala or Asp
DIVMTQSQKFISTSVGDRVSITCKASQSVRIAVAWFQQKPGQSPKALIYLASTRHTGVPDRFTGSGSGTDFTLTISNVQSEDLADYFCLQHXXYPYTFGGGTKLEIK

SEQ ID NO: 52 - protein, 96 aa, Artificial Sequence
  Humanized sequences of CHA.7.538_1 antibody VL
  MOD_RES (92)..(92): Tyr, Phe or His
  MOD_RES (93)..(93): Gln, Ser, Ala or Asp
DIQMTQSPSSLSASVGDRVTITCRASQSISSYLNWYQQKPGKAPKLLIYAASSLQSGVPSRFSGSGSGTDFTLTISSLQPEDFATYYCQQSXXTPP

SEQ ID NO: 53 - protein, 107 aa, Artificial Sequence
  Humanized sequences of CHA.7.538_1 antibody VL
  MOD_RES (92)..(92): Trp, Tyr, Phe or His
  MOD_RES (93)..(93): Asn, Gln, Ser, Ala or Asp
DIQMTQSPSSLSASVGDRVTITCKASQSVRIAVAWYQQKPGKAPKLLIYLASTRHTGVPSRFSGSGSGTDFTLTISSLQPEDFATYYCLQHXXYPYTFGQGTKLEIK

SEQ ID NO: 54 - protein, 107 aa, Artificial Sequence
  Humanized sequences of CHA.7.538_1 antibody VL
  MOD_RES (92)..(92): Trp, Tyr, Phe or His
  MOD_RES (93)..(93): Asn, Gln, Ser, Ala or Asp
DIQMTQSPSSLSASVGDRVTITCKASQSVRIAVAWFQQKPGKAPKALIYLASTRHTGVPSRFSGSGSGTDFTLTISSVQPEDFATYYCLQHXXYPYTFGQGTKLEIK

SEQ ID NO: 55 - protein, 98 aa, Artificial Sequence; identical to SEQ ID NO: 40
  Humanized sequences of CHA.7.538_2 antibody VH

SEQ ID NO: 56 - protein, 15 aa, Artificial Sequence
  Humanized sequences of CHA.7.538_2 antibody VH
YFDYWGQGTLVTVSS

SEQ ID NO: 57 - protein, 120 aa, Artificial Sequence
  Humanized sequences of CHA.7.538_2 antibody VH
  MOD_RES (31)..(31): Asn, Gln, Ser or Ala
  MOD_RES (33)..(33): Trp, Tyr, Phe or His
  MOD_RES (59)..(59): Asn, Gln, Ser or Ala
QVQLQQSGAELVRPGTSVKMSCKAAGYTFTXYXIGWVKQRPGHGLEWIGDIYPGGGYTXYNEKFKGKATLTADTSSSTAYMQLSSLTSEDSAIYYCASPYYGSSYGFAFWGQGTLVTVSA

SEQ ID NO: 58 - protein, 98 aa, Artificial Sequence
  Humanized sequences of CHA.7.538_2 antibody VH
  MOD_RES (31)..(31): Gln, Ser or Ala
  MOD_RES (33)..(33): Tyr, Phe or His
  MOD_RES (59)..(59): Gln, Ser or Ala
QVQLVQSGAEVKKPGASVKVSCKASGYTFTXYXMHWVRQAPGQGLEWMGIINPSGGSTXYAQKFQGRVTMTRDTSTSTVYMELSSLRSEDTAVYYCAR

SEQ ID NO: 59 - protein, 120 aa, Artificial Sequence
  Humanized sequences of CHA.7.538_2 antibody VH
  MOD_RES (31)..(31): Asn, Gln, Ser or Ala
  MOD_RES (33)..(33): Trp, Tyr, Phe or His
  MOD_RES (59)..(59): Asn, Gln, Ser or Ala
QVQLVQSGAEVKKPGASVKVSCKASGYTFTXYXIGWVRQAPGQGLEWMGDIYPGGGYTXYAQKFQGRVTMTRDTSTSTVYMELSSLRSEDTAVYYCARPYYGSSYGFAFWGQGTLVTVSS

SEQ ID NO: 60 - protein, 120 aa, Artificial Sequence
  Humanized sequences of CHA.7.538_2 antibody VH
  MOD_RES (31)..(31): Asn, Gln, Ser or Ala
  MOD_RES (33)..(33): Trp, Tyr, Phe or His
  MOD_RES (59)..(59): Asn, Gln, Ser or Ala
QVQLVQSGAEVKKPGASVKVSCKASGYTFTXYXIGWVRQAPGQGLEWIGDIYPGGGYTXYAQKFQGRVTMTADTSTSTVYMELSSLRSEDTAVYYCASPYYGSSYGFAFWGQGTLVTVSS

SEQ ID NO: 61 - protein, 120 aa, Artificial Sequence
  Humanized sequences of CHA.7.538_2 antibody VH
  MOD_RES (31)..(31): Asn, Gln, Ser or Ala
  MOD_RES (33)..(33): Trp, Tyr, Phe or His
  MOD_RES (59)..(59): Asn, Gln, Ser or Ala
QVQLVQSGAEVKKPGASVKMSCKASGYTFTXYXIGWVRQAPGQGLEWIGDIYPGGGYTXYAQKFQGRATLTADTSTSTAYMELSSLRSEDTAVYYCASPYYGSSYGFAFWGQGTLVTVSS

SEQ ID NO: 62 - protein, 120 aa, Artificial Sequence; identical to SEQ ID NO: 5
  humanized CHA.7.518 VH h518HH1

SEQ ID NO: 63 - protein, 120 aa, Artificial Sequence
  humanized CHA.7.518 VH h518HH2
QVQLVQSGAEVKKPGASVKVSCKASGYTFTDYNINWVRQAPGQGLEWIGYIYPYIGGSGYAQKFQGRVTMTADTSTSTVYMELSSLRSEDTAVYYCAREDKTARNAMDYWGQGTLVTVSS

SEQ ID NO: 64 - protein, 120 aa, Artificial Sequence
  humanized CHA.7.518 VH h518HH3
QVQLVQSGAEVKKPGASVKISCKASGYTFTDYNINWVRQAPGQGLEWIGYIYPYIGGSGYAQKFQGRATLTADTSTSTAYMELSSLRSEDTAVYYCAREDKTARNAMDYWGQGTLVTVSS

SEQ ID NO: 65 - protein, 120 aa, Artificial Sequence
  humanized CHA.7.518 VH h518HH4
QVQLVQSGAEVKKPGASVKISCKASGYTFTDYNINWVRQAPGQGLEWIGYIYPYIGGSGYAQKFQGRATLTADNSTSTAYMELSSLRSEDTAVYYCAREDKTARNAMDYWGQGTLVTVSS

SEQ ID NO: 66 - protein, 107 aa, Artificial Sequence; identical to SEQ ID NO: 10
  humanized CHA.7.518 VL h518HL1

SEQ ID NO: 67 - protein, 107 aa, Artificial Sequence
  humanized CHA.7.518 VL h518HL2
DIQMTQSPSSLSASVGDRVTITCRVSENIYSNLAWYQQKPGKAPKLLIYEATNLAEGVPSRFSGSGSGTDYTLTISSLQPEDFATYYCQHFWGTPYTFGQGTKLEIK

SEQ ID NO: 68 - protein, 107 aa, Artificial Sequence
  humanized CHA.7.518 VL h518HL3
DIQMTQSPSSLSASVGDRVTITCRVSENIYSNLAWYQQKPGKAPKLLVYEATNLAEGVPSRFSGSGSGTDYTLTISSLQPEDFGTYYCQHFWGTPYTFGQGTKLEIK

SEQ ID NO: 69 - protein, 119 aa, Artificial Sequence
  humanized CHA.7.538_1 VH h5381HH1
QVQLVQSGAEVKKPGASVKVSCKASGYAFTNYLIEWVRQAPGQGLEWMGVINPGSGGIYYAQKFQGRVTMTRDTSTSTVYMELSSLRSEDTAVYYCARSETHDTWFAYWGQGTLVTVSS

SEQ ID NO: 70 - protein, 119 aa, Artificial Sequence; identical to SEQ ID NO: 15
  humanized CHA.7.538_1 VH h5381HH2

SEQ ID NO: 71 - protein, 119 aa, Artificial Sequence
  humanized CHA.7.538_1 VH h5381HH3
QVQLVQSGAEVKKPGASVKVSCKTSGYAFTNYLIEWVRQAPGQGLEWIGVINPGSGGIYYAQKFQGRVTLTADTSTSTAYMELSSLRSEDTAVYYCARSETHDTWFAYWGQGTLVTVSS

SEQ ID NO: 72 - protein, 119 aa, Artificial Sequence
  humanized CHA.7.538_1 VH h5381HH4
QVQLVQSGAEVKKPGASVKVSCKTSGYAFTNYLIEWVRQAPGQGLEWIGVINPGSGGIYYAQKFQGRVTLTADKSTSTAYMELSSLRSEDTAVYYCARSETHDTWFAYWGQGTLVTVSS

SEQ ID NO: 73 - protein, 107 aa, Artificial Sequence
  humanized CHA.7.538_1/538_2 VL h538HL1
DIQMTQSPSSLSASVGDRVTITCKASQSVRIAVAWYQQKPGKAPKLLIYLASTRHTGVPSRFSGSGSGTDFTLTISSLQPEDFATYYCLQHWNYPYTFGQGTKLEIK

SEQ ID NO: 74 - protein, 107 aa, Artificial Sequence; identical to SEQ ID NO: 20
  humanized CHA.7.538_1/538_2 VL h538HL2

SEQ ID NO: 75 - protein, 120 aa, Artificial Sequence
  humanized CHA.7.538_2 VH h5382HH1
QVQLVQSGAEVKKPGASVKVSCKASGYTFTNYWIGWVRQAPGQGLEWMGDIYPGGGYTNYAQKFQGRVTMTRDTSTSTVYMELSSLRSEDTAVYYCARPYYGSSYGFAFWGQGTLVTVSS

SEQ ID NO: 76 - protein, 120 aa, Artificial Sequence
  humanized CHA.7.538_2 VH h5382HH2
QVQLVQSGAEVKKPGASVKVSCKASGYTFTNYWIGWVRQAPGQGLEWIGDIYPGGGYTNYAQKFQGRVTMTADTSTSTVYMELSSLRSEDTAVYYCASPYYGSSYGFAFWGQGTLVTVSS

SEQ ID NO: 77 - protein, 120 aa, Artificial Sequence
  humanized CHA.7.538_2 VH h5382HH3
QVQLVQSGAEVKKPGASVKMSCKASGYTFTNYWIGWVRQAPGQGLEWIGDIYPGGGYTNYAQKFQGRATLTADTSTSTAYMELSSLRSEDTAVYYCASPYYGSSYGFAFWGQGTLVTVSS

SEQ ID NO: 78 - protein, 107 aa, Artificial Sequence; identical to SEQ ID NO: 73
  humanized CHA.7.538_1/538_2 VL h538HL1

SEQ ID NO: 79 - protein, 107 aa, Artificial Sequence; identical to SEQ ID NO: 20
  humanized CHA.7.538_1/538_2 VL h538HL2

SEQ ID NO: 80 - protein, 131 aa, Artificial Sequence
  Sequence alignment of PVRIG orthologs
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRAD

SEQ ID NO: 81 - protein, 131 aa, Artificial Sequence
  Sequence alignment of PVRIG orthologs
TPEVWVQVQMEATELSSFTVHCGFLGPGSISLVTVSWGGPDGAGGTKLAVLHPELGTRQWAPARQARWETQSSISLALEDSGASSPFANTTFCCKFASFPEGSWESCGSLPPSSDPGLSAPPTPVPILRAD

SEQ ID NO: 82 - protein, 126 aa, Artificial Sequence
  Sequence alignment of PVRIG orthologs
TPEVWVQVQMKATELSSFIVHCGFLGSGSISLVTVSWGGPDGAGGTRLAVLHPELGTRQWAPAHQARWETQSSISLVLEEPGASSPSANTTFCCKFASFPEGSWEACGSLPPSSDPGLSAPILRAD

SEQ ID NO: 83 - protein, 131 aa, Artificial Sequence; identical to SEQ ID NO: 81
  Sequence alignment of PVRIG orthologs

SEQ ID NO: 84 - protein, 166 aa, Artificial Sequence
  Heavy chain: Amino acid sequence
MEWNWVFLFLLSVTAGVHSQVQLQQSGAELAKPGSSVMISCKASGYTFTNYAVHWIKQTTGQALEWTGYIAPGSGVTKYNEKFKGKATLTVDKSSTTAYMQLSSLTPVDTAVYYCASGTTRFAYWGQGTLVTVSSAQTTAPSVYPLAPGCGDTTSSTVTLGCLVKG

SEQ ID NO: 85 - DNA, 498 bp, Artificial Sequence
  Heavy chain: DNA sequence
atggaatggaactgggtctttctcttcctcctgtcagtaactgcaggagtccactcccaggtccagctgcagcagtctggagctgagctggcaaagcctggctcttcagtgatgatttcctgcaaggcttctggttacacctttaccaactatgctgtgcactggataaagcagacgactggacaggcccttgagtggactggatatattgctcctggaagtggagttactaaatacaatgagaagttcaagggcaaggccacattgactgtagacaaatcctcaaccacagcctacatgcaactcagcagcctgacacctgtggacactgcggtctattactgtgcaagcggaactacgaggtttgcttattggggccaaggcactctggtcactgtctcttcagcccaaacaacagccccatctgtctatccactggctcctggatgtggtgatacaaccagctccacggtgactctgggatgcctggtcaagggc

SEQ ID NO: 86 - protein, 130 aa, Artificial Sequence
  Light chain: Amino acid sequence
METDTLLLWVLLLWVPGSTGDIVLTQSPALAVSLGQRATISCRASQSVSLSSYNLMQWYQQKPGQEPKILIYDASNLPSGIPARFSGSGSGTDFTLTIDPVQADDIATYYCQQSKDDPLTFGSGTKLEIK

SEQ ID NO: 87 - DNA, 390 bp, Artificial Sequence
  Light chain: DNA sequence
atggagacagacacactcctgctatgggtgctgctgctctgggttccaggctccactggtgacattgtgctgacccagtctcctgctttggctgtgtctctagggcagagggccacaatctcctgtagagccagccaaagtgtcagtttatccagctataatctcatgcagtggtaccaacagaaaccaggacaggaacccaaaatcctcatctatgatgcatccaacctaccatctgggatccctgccaggttcagtggcagtgggtctgggacagacttcaccctcaccattgatcctgtgcaggctgatgatattgcaacctattactgtcagcagagtaaggatgacccgctcacgttcggttctgggaccaagctggagatcaaa

SEQ ID NO: 88 - protein, 330 aa, Artificial Sequence
  Human IgG1 constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 89 - protein, 330 aa, Artificial Sequence
  Human IgG1 D265A constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 330 aa, Artificial Sequence
  Human IgG1 N297A constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 91 - protein, 326 aa, Artificial Sequence
  Human IgG2 constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 92 - protein, 377 aa, Artificial Sequence
  Human IgG3 constant region
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 93 - protein, 327 aa, Artificial Sequence
  Human IgG4 constant region (Wild Type)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 94 - protein, 327 aa, Artificial Sequence
  Human IgG4 constant region (S241P hinge mutant)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 95 - protein, 107 aa, Artificial Sequence [sequence omitted]

SEQ ID NO: 96 - protein, 106 aa, Artificial Sequence
  Human lambda light chain
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 97 - protein, 120 aa, Artificial Sequence
  Human TIGIT ECD
MMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIP

SEQ ID NO: 98 - protein, 121 aa, Artificial Sequence
  Cyno macaque TIGIT ECD
MMTGTIETTGNISAKKGGSVILQCHLSSTMAQVTQVNWEQHDHSLLAIRNAELGWHIYPAFKDRVAPGPGLGLTLQSLTMNDTGEYFCTYHTYPDGTYRGRIFLEVLESSVAEHSARFQIP

SEQ ID NO: 99 - protein, 316 aa, Artificial Sequence
  Human PVR ECD
DVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGMSRN

SEQ ID NO: 100 - protein, 121 aa, Artificial Sequence
  CPA.9.018 Variable heavy (vh) domain
QVQLVESGGGLVQPGGSLRLSCAASGFTFSSYGMHWVRQAPGKGLEWVAFIRYDGSNKYYADSVKGRFTISRDNSKNTLYLQMNSLRAEDTAVYYCAKEMLVQDYYYMDVWGQGTTVTVSS

SEQ ID NO: 101 - protein, 8 aa, Artificial Sequence
  vhCDR1
GFTFSSYG

SEQ ID NO: 102 - protein, 8 aa, Artificial Sequence
  vhCDR2
IRYDGSNK

SEQ ID NO: 103 - protein, 14 aa, Artificial Sequence
  vhCDR3
AKEMLVQDYYYMDV

SEQ ID NO: 104 - protein, 448 aa, Artificial Sequence
  Full length HC (IgG4(S241P))
QVQLVESGGGLVQPGGSLRLSCAASGFTFSSYGMHWVRQAPGKGLEWVAFIRYDGSNKYYADSVKGRFTISRDNSKNTLYLQMNSLRAEDTAVYYCAKEMLVQDYYYMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 105 - protein, 113 aa, Artificial Sequence
  Variable light (vl) domain
DVVMTQSPLSLPVSPGEPASISCRSSQNLLHRNGINYLNWYLQKPGQSPQLLIYWGSNRASGVPDRFSGSGSGTDFTLKISRVEAEDVGVYYCMQGLQIPPTFGQGTKVDIKR

SEQ ID NO: 106 - protein, 11 aa, Artificial Sequence
  vlCDR1
QNLLHRNGINY

SEQ ID NO: 107 - protein, 3 aa, Artificial Sequence
  vlCDR2
WGS

SEQ ID NO: 108 - protein, 9 aa, Artificial Sequence
  vlCDR3
MQGLQIPPT

SEQ ID NO: 109 - protein, 219 aa, Artificial Sequence
  Full length light chain
DVVMTQSPLSLPVSPGEPASISCRSSQNLLHRNGINYLNWYLQKPGQSPQLLIYWGSNRASGVPDRFSGSGSGTDFTLKISRVEAEDVGVYYCMQGLQIPPTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 110 - protein, 121 aa, Artificial Sequence
  CPA.9.027 Variable heavy (vh) domain
EVQLVETGGGLIQPGRSLRLSCAASGFTFSSYAMHWVRQAPGKGLEWVAVISYDGSNKYYADSVKGRFTISRDNSKNTLYLQMNSLRAEDTAVYYCARDPLPLHYYGMDVWGQGTTVTVSS

SEQ ID NO: 111 - protein, 8 aa, Artificial Sequence
  vhCDR1
GFTFSSYA

SEQ ID NO: 112 - protein, 8 aa, Artificial Sequence
  vhCDR2
ISYDGSNK

SEQ ID NO: 113 - protein, 14 aa, Artificial Sequence
  vhCDR3
ARDPLPLHYYGMDV

SEQ ID NO: 114 - protein, 448 aa, Artificial Sequence
  Full length HC (IgG4(S241P))
EVQLVETGGGLIQPGRSLRLSCAASGFTFSSYAMHWVRQAPGKGLEWVAVISYDGSNKYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 115 - protein, 111 aa, Artificial Sequence
  Variable light (vl) domain
QSALTQPRSASGNPGQRVTISCSGSSSNMGRRPVNWYQQIPGTAPKLLIYSQNQRPSGVPDRFSGSQSGTSASLTISGLQSEDEAEYFCAVWDDSLSSLQLGGGTQLAVLG

SEQ ID NO: 116 - protein, 8 aa, Artificial Sequence
  vlCDR1
SSNMGRRP

SEQ ID NO: 117 - protein, 3 aa, Artificial Sequence
  vlCDR2
SQN

SEQ ID NO: 118 - protein, 11 aa, Artificial Sequence
  vlCDR3
AVWDDSLSSLQ

SEQ ID NO: 119 - protein, 216 aa, Artificial Sequence
  Full length light chain
QSALTQPRSASGNPGQRVTISCSGSSSNMGRRPVNWYQQIPGTAPKLLIYSQNQRPSGVPDRFSGSQSGTSASLTISGLQSEDEAEYFCAVWDDSLSSLQLGGGTQLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 120 - protein, 121 aa, Artificial Sequence; identical to SEQ ID NO: 110
  CPA.9.049 Variable heavy (vh) domain

SEQ ID NO: 121 - protein, 8 aa, Artificial Sequence
  vhCDR1
GFTFSSYA

SEQ ID NO: 122 - protein, 8 aa, Artificial Sequence
  vhCDR2
ISYDGSNK

SEQ ID NO: 123 - protein, 14 aa, Artificial Sequence
  vhCDR3
ARDPLPLHYYGMDV

SEQ ID NO: 124 - protein, 448 aa, Artificial Sequence; identical to SEQ ID NO: 114
  Full length HC (IgG4(S241P))

SEQ ID NO: 125 - protein, 111 aa, Artificial Sequence
  Variable light (vl) domain
QSALTQPRSASGNPGQRVTISCSGSSSNMGRRPVNWYQQIPGTAPKLLIYSQNQRPSGVPDRFSGSQSGTSASLTISGLQSEDEAEYFCAVWDDSLFSLLLGGGTQLAVLG

SEQ ID NO: 126 - protein, 8 aa, Artificial Sequence
  vlCDR1
SSNMGRRP

SEQ ID NO: 127 - protein, 3 aa, Artificial Sequence
  vlCDR2
SQN

SEQ ID NO: 128 - protein, 11 aa, Artificial Sequence
  vlCDR3
AVWDDSLFSLL

SEQ ID NO: 129 - protein, 216 aa, Artificial Sequence
  Full length light chain
QSALTQPRSASGNPGQRVTISCSGSSSNMGRRPVNWYQQIPGTAPKLLIYSQNQRPSGVPDRFSGSQSGTSASLTISGLQSEDEAEYFCAVWDDSLFSLLLGGGTQLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 130 - protein, 121 aa, Artificial Sequence
  CPA.9.057 Variable heavy (vh) domain
QVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQGAAAGNPFDIWGQGTMVTVSS

SEQ ID NO: 131 - protein, 10 aa, Artificial Sequence
  vhCDR1
GGSISSSSYY

SEQ ID NO: 132 - protein, 7 aa, Artificial Sequence
  vhCDR2
IYYSGST

SEQ ID NO: 133 - protein, 13 aa, Artificial Sequence
  vhCDR3
ARQGAAAGNPFDI

SEQ ID NO: 134 - protein, 448 aa, Artificial Sequence
  Full length HC (IgG4(S241P))
QVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQGAAAGNPFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 135 - protein, 111 aa, Artificial Sequence
  Variable light (vl) domain
QSVLTQPPSVSGTPGQRVTISCSGSSSNIGSNFVYWHQQLTGTAPKLLIYRNTQRPSGVPDRFSGSKSGTSASLAIGGLRSEDEADYYCATWDDSLSAWVFGGGTKLTVLG

SEQ ID NO: 136 - protein, 8 aa, Artificial Sequence
  vlCDR1
SSNIGSNF

SEQ ID NO: 137 - protein, 3 aa, Artificial Sequence
  vlCDR2
RNT

SEQ ID NO: 138 - protein, 11 aa, Artificial Sequence
  vlCDR3
ATWDDSLSAWV

SEQ ID NO: 139 - protein, 216 aa, Artificial Sequence
  Full length light chain
QSVLTQPPSVSGTPGQRVTISCSGSSSNIGSNFVYWHQQLTGTAPKLLIYRNTQRPSGVPDRFSGSKSGTSASLAIGGLRSEDEADYYCATWDDSLSAWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 140 - protein, 119 aa, Artificial Sequence
  CPA.9.059 Variable heavy (vh) domain
EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGARYSYGQYPYWGQGTLVTVSS

SEQ ID NO: 141 - protein, 8 aa, Artificial Sequence
  vhCDR1
GFTVSSNY

SEQ ID NO: 142 - protein, 7 aa, Artificial Sequence
  vhCDR2
IYSGGST

SEQ ID NO: 143 - protein, 13 aa, Artificial Sequence
  vhCDR3
ARGARYSYGQYPY

SEQ ID NO: 144 - protein, 446 aa, Artificial Sequence
  Full length HC (IgG4(S241P))
EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGARYSYGQYPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 145 - protein, 109 aa, Artificial Sequence
  Variable light (vl) domain
DIQLTQSPSFLSASVGDRVTITCRASHDISSLFSWYQQKPGKAPKLLIYAASTLQTGVPSRFSGSASGTEFTLTISSLQPEDFATYYCLQLDSFPTWTFGQGTKVEIKR

SEQ ID NO: 146 - protein, 6 aa, Artificial Sequence
  vlCDR1
HDISSL

SEQ ID NO: 147 - protein, 3 aa, Artificial Sequence
  vlCDR2
AAS

SEQ ID NO: 148 - protein, 10 aa, Artificial Sequence
  vlCDR3
LQLDSFPTWT

SEQ ID NO: 149 - protein, 215 aa, Artificial Sequence
  Full length light chain
DIQLTQSPSFLSASVGDRVTITCRASHDISSLFSWYQQKPGKAPKLLIYAASTLQTGVPSRFSGSASGTEFTLTISSLQPEDFATYYCLQLDSFPTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 150 - protein, 121 aa, Artificial Sequence
  CPA.9.083  Variable heavy (vh) domain
EVQLVETGGGLIQPGRSLRLSCAASGFTFSSYAMHWVRQAPGKGLEWVAVISYDGTPVYYADSVKGRFTISRDNSKNTLYLQMNSLRAEDTAVYYCARDPLPLHYYGMDVWGQGTTVTVSS

SEQ ID NO: 151 - protein, 8 aa, Artificial Sequence
  vhCDR1
GFTFSSYA

SEQ ID NO: 152 - protein, 8 aa, Artificial Sequence
  vhCDR2
ISYDGTPV

SEQ ID NO: 153 - protein, 14 aa, Artificial Sequence
  vhCDR3
ARDPLPLHYYGMDV

SEQ ID NO: 154 - protein, 448 aa, Artificial Sequence
  Full length HC (IgG4(S241P))
EVQLVETGGGLIQPGRSLRLSCAASGFTFSSYAMHWVRQAPGKGLEWVAVISYDGTPVYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 155 - protein, 111 aa, Artificial Sequence
  Variable light (vl) domain
QSALTQPRSASGNPGQRVTISCSGSSSNMGRRPVNWYQQIPGTAPKLLIYSQNQRPSGVPDRFSGSQSGTSASLTISGLQSEDEAEYFCAVWDGDRRSLQLGGGTQLAVLG

SEQ ID NO: 156 - protein, 8 aa, Artificial Sequence
  vlCDR1
SSNMGRRP

SEQ ID NO: 157 - protein, 3 aa, Artificial Sequence
  vlCDR2
SQN

SEQ ID NO: 158 - protein, 11 aa, Artificial Sequence
  vlCDR3
AVWDGDRRSLQ

SEQ ID NO: 159 - protein, 216 aa, Artificial Sequence
  Full length light chain
QSALTQPRSASGNPGQRVTISCSGSSSNMGRRPVNWYQQIPGTAPKLLIYSQNQRPSGVPDRFSGSQSGTSASLTISGLQSEDEAEYFCAVWDGDRRSLQLGGGTQLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 160 - protein, 121 aa, Artificial Sequence
  CPA.9.086   Variable heavy (vh) domain
EVQLVETGGGLIQPGRSLRLSCAASGFTFSSYAMHWVRQAPGKGLEWVAVISYAGEVKYYADSVKGRFTISRDNSKNTLYLQMNSLRAEDTAVYYCARDPLPLHYYGMDVWGQGTTVTVSS

SEQ ID NO: 161 - protein, 8 aa, Artificial Sequence
  vhCDR1
GFTFSSYA

SEQ ID NO: 162 - protein, 8 aa, Artificial Sequence
  vhCDR2
ISYAGEVK

SEQ ID NO: 163 - protein, 14 aa, Artificial Sequence
  vhCDR3
ARDPLPLHYYGMDV

SEQ ID NO: 164 - protein, 448 aa, Artificial Sequence
  Full length HC (IgG4(S241P))
EVQLVETGGGLIQPGRSLRLSCAASGFTFSSYAMHWVRQAPGKGLEWVAVISYAGEVKYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 165 - protein, 111 aa, Artificial Sequence
  Variable light (vl) domain
QSALTQPRSASGNPGQRVTISCSGSSSNMGRRPVNWYQQIPGTAPKLLIYSQNQRPSGVPDRFSGSQSGTSASLTISGLQSEDEAEYFCAVWDDIGRVLQLGGGTQLAVLG

SEQ ID NO: 166 - protein, 8 aa, Artificial Sequence
  vlCDR1
SSNMGRRP

SEQ ID NO: 167 - protein, 3 aa, Artificial Sequence
  vlCDR2
SQN

SEQ ID NO: 168 - protein, 11 aa, Artificial Sequence
  vlCDR3
AVWDDIGRVLQ

SEQ ID NO: 169 - protein, 216 aa, Artificial Sequence
  Full length light chain
QSALTQPRSASGNPGQRVTISCSGSSSNMGRRPVNWYQQIPGTAPKLLIYSQNQRPSGVPDRFSGSQSGTSASLTISGLQSEDEAEYFCAVWDDIGRVLQLGGGTQLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 170 - protein, 121 aa, Artificial Sequence
  CPA.9.089 Variable heavy (vh) domain
EVQLVETGGGLIQPGRSLRLSCAASGFTFSSYAMHWVRQAPGKGLEWVAVISYDRTPVYYADSVKGRFTISRDNSKNTLYLQMNSLRAEDTAVYYCARDPLPLHYYGMDVWGQGTTVTVSS

SEQ ID NO: 171 - protein, 8 aa, Artificial Sequence
  vhCDR1
GFTFSSYA

SEQ ID NO: 172 - protein, 8 aa, Artificial Sequence
  vhCDR2
ISYDRTPV

SEQ ID NO: 173 - protein, 14 aa, Artificial Sequence
  vhCDR3
ARDPLPLHYYGMDV

SEQ ID NO: 174 - protein, 448 aa, Artificial Sequence
  Full length HC (IgG4(S241P))
EVQLVETGGGLIQPGRSLRLSCAASGFTFSSYAMHWVRQAPGKGLEWVAVISYDRTPVYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 175 - protein, 111 aa, Artificial Sequence
  Variable light (vl) domain
QSALTQPRSASGNPGQRVTISCSGSSSNMGRRPVNWYQQIPGTAPKLLIYSQNQRPSGVPDRFSGSQSGTSASLTISGLQSEDEAEYFCATWDDSLPRLNFGGGTKLAVLG

SEQ ID NO: 176 - protein, 8 aa, Artificial Sequence
  vlCDR1
SSNMGRRP

SEQ ID NO: 177 - protein, 3 aa, Artificial Sequence
  vlCDR2
SQN

SEQ ID NO: 178 - protein, 11 aa, Artificial Sequence
  vlCDR3
ATWDDSLPRLN

SEQ ID NO: 179 - protein, 216 aa, Artificial Sequence
  Full length light chain
QSALTQPRSASGNPGQRVTISCSGSSSNMGRRPVNWYQQIPGTAPKLLIYSQNQRPSGVPDRFSGSQSGTSASLTISGLQSEDEAEYFCATWDDSLPRLNFGGGTKLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 180 - protein, 121 aa, Artificial Sequence
  CPA.9.093 Variable heavy (vh) domain
EVQLVETGGGLIQPGRSLRLSCAASGFTFSSYAMHWVRQAPGKGLEWVAVISYEGDRKYYADSVKGRFTISRDNSKNTLYLQMNSLRAEDTAVYYCARDPLPLHYYGMDVWGQGTTVTVSS

SEQ ID NO: 181 - protein, 8 aa, Artificial Sequence
  vhCDR1
GFTFSSYA

SEQ ID NO: 182 - protein, 8 aa, Artificial Sequence
  vhCDR2
ISYEGDRK

SEQ ID NO: 183 - protein, 14 aa, Artificial Sequence
  vhCDR3
ARDPLPLHYYGMDV

SEQ ID NO: 184 - protein, 448 aa, Artificial Sequence
  Full length HC (IgG4(S241P))
EVQLVETGGGLIQPGRSLRLSCAASGFTFSSYAMHWVRQAPGKGLEWVAVISYEGDRKYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 185 - protein, 111 aa, Artificial Sequence
  Variable light (vl) domain
QSALTQPRSASGNPGQRVTISCSGSSSNMGRRPVNWYQQIPGTAPKLLIYSQNQRPSGVPDRFSGSQSGTSASLTISGLQSEDEAEYFCATWDDSTPHGVFGGGTKLAVLG

SEQ ID NO: 186 - protein, 8 aa, Artificial Sequence
  vlCDR1
SSNMGRRP

SEQ ID NO: 187 - protein, 3 aa, Artificial Sequence
  vlCDR2
SQN

SEQ ID NO: 188 - protein, 11 aa, Artificial Sequence
  vlCDR3
ATWDDSTPHGV

SEQ ID NO: 189 - protein, 216 aa, Artificial Sequence
  Full length light chain
QSALTQPRSASGNPGQRVTISCSGSSSNMGRRPVNWYQQIPGTAPKLLIYSQNQRPSGVPDRFSGSQSGTSASLTISGLQSEDEAEYFCATWDDSTPHGVFGGGTKLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 190 - protein, 118 aa, Artificial Sequence
  CPA.9.101  Variable heavy (vh) domain
EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGAPLFGQYPYWGQGTLVTVSS

SEQ ID NO: 191 - protein, 8 aa, Artificial Sequence
  vhCDR1
GFTVSSNY

SEQ ID NO: 192 - protein, 7 aa, Artificial Sequence
  vhCDR2
IYSGGST

SEQ ID NO: 193 - protein, 12 aa, Artificial Sequence
  vhCDR3
ARGAPLFGQYPY

SEQ ID NO: 194 - protein, 445 aa, Artificial Sequence
  Full length HC (IgG4(S241P))
EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGAPLFGQYPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 195 - protein, 109 aa, Artificial Sequence
  Variable light (vl) domain
DIQMTQSPSSLSASVGDRVTITCRASHAIASLFSWYQQKPGKAPKLLIYAASTLQTGVPSRFSGSASGTEFTLTISSLQPEDFATYYCLQLDSFPTWTFGQGTKVEIKR

SEQ ID NO: 196 - protein, 6 aa, Artificial Sequence
  vlCDR1
HAIASL

SEQ ID NO: 197 - protein, 3 aa, Artificial Sequence
  vlCDR2
AAS

SEQ ID NO: 198 - protein, 10 aa, Artificial Sequence
  vlCDR3
LQLDSFPTWT

SEQ ID NO: 199 - protein, 215 aa, Artificial Sequence
  Full length light chain
DIQMTQSPSSLSASVGDRVTITCRASHAIASLFSWYQQKPGKAPKLLIYAASTLQTGVPSRFSGSASGTEFTLTISSLQPEDFATYYCLQLDSFPTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 200 - protein, 118 aa, Artificial Sequence
  CPA.9.103 Variable heavy (vh) domain
EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGARPNGQYPYWGQGTLVTVSS

SEQ ID NO: 201 - protein, 8 aa, Artificial Sequence
  vhCDR1
GFTVSSNY

SEQ ID NO: 202 - protein, 7 aa, Artificial Sequence
  vhCDR2
IYSGGST

SEQ ID NO: 203 - protein, 12 aa, Artificial Sequence
  vhCDR3
ARGARPNGQYPY

SEQ ID NO: 204 - protein, 445 aa, Artificial Sequence
  Full length HC (IgG4(S241P))
EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGARPNGQYPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 205 - protein, 109 aa, Artificial Sequence
  Variable light (vl) domain
DIQLTQSPSFLSASVGDRVTITCRASHGIKSLFSWYQQKPGKAPKLLIYAASTLQTGVPSRFSGSASGTEFTLTISSLQPEDFATYYCLQLDSFPTWTFGQGTKVEIKR

SEQ ID NO: 206 - protein, 6 aa, Artificial Sequence
  vlCDR1
HGIKSL

SEQ ID NO: 207 - protein, 3 aa, Artificial Sequence
  vlCDR2
AAS

SEQ ID NO: 208 - protein, 10 aa, Artificial Sequence
  vlCDR3
LQLDSFPTWT

SEQ ID NO: 209 - protein, 215 aa, Artificial Sequence
  Full length light chain
DIQLTQSPSFLSASVGDRVTITCRASHGIKSLFSWYQQKPGKAPKLLIYAASTLQTGVPSRFSGSASGTEFTLTISSLQPEDFATYYCLQLDSFPTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 210 - protein, 119 aa, Artificial Sequence
  Clone 31C6 Variable heavy (vh) domain
EVQLQQSGPELVKPGSSVKMSCKASGYTFSSYVMHWVKQKPGQGLEWIGYIDPYNDGAKYNEKFKGKATLTSDKSSSTAYMELSSLTSEDSAVYYCARGGPYGWYFDVWGAGTTVTVSS

SEQ ID NO: 211 - protein, 8 aa, Artificial Sequence
  vhCDR1
GYTFSSYV

SEQ ID NO: 212 - protein, 8 aa, Artificial Sequence
  vhCDR2
IDPYNDGA

SEQ ID NO: 213 - protein, 12 aa, Artificial Sequence
  vhCDR3
ARGGPYGWYFDV

SEQ ID NO: 214 - protein, 446 aa, Artificial Sequence
  Full length HC (IgG4(S241P))
EVQLQQSGPELVKPGSSVKMSCKASGYTFSSYVMHWVKQKPGQGLEWIGYIDPYNDGAKYNEKFKGKATLTSDKSSSTAYMELSSLTSEDSAVYYCARGGPYGWYFDVWGAGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 215 - protein, 107 aa, Artificial Sequence
  Variable light (vl) domain
DIQMTQSPASLSASVGETVTITCRASEHIYSYLSWYQQKQGKSPQLLVYNAKTLAEGVPSRFSGSGSGTQFSLKINSLQPEDFGTYYCQHHFGSPLTFGAGTTLELK

SEQ ID NO: 216 - protein, 6 aa, Artificial Sequence
  vlCDR1
EHIYSY

SEQ ID NO: 217 - protein, 3 aa, Artificial Sequence
  vlCDR2
NAK

SEQ ID NO: 218 - protein, 9 aa, Artificial Sequence
  vlCDR3
QHHFGSPLT

SEQ ID NO: 219 - protein, 214 aa, Artificial Sequence
  Full length light chain
DIQMTQSPASLSASVGETVTITCRASEHIYSYLSWYQQKQGKSPQLLVYNAKTLAEGVPSRFSGSGSGTQFSLKINSLQPEDFGTYYCQHHFGSPLTFGAGTTLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 220 - protein, 130 aa, Artificial Sequence
  Clone 22G2 Variable heavy (vh) domain
QVHLQESGPGLVKPSETLSLTCTVSGGSVSSGIYYWSWIRQPPGKGLEWIGYIYYSGSTNYNPSLKSRVTISVDTSKNQFSLKLSSVTAADTAVYYCARDYYVSGNYYNVDYYFFGVDVWGQGTTVTVSS

SEQ ID NO: 221 - protein, 10 aa, Artificial Sequence
  vhCDR1
GGSVSSGIYY

SEQ ID NO: 222 - protein, 7 aa, Artificial Sequence
  vhCDR2
IYYSGST

SEQ ID NO: 223 - protein, 22 aa, Artificial Sequence
  vhCDR3
ARDYYVSGNYYNVDYYFFGVDV

SEQ ID NO: 224 - protein, 457 aa, Artificial Sequence
  Full length HC (IgG4(S241P))
QVHLQESGPGLVKPSETLSLTCTVSGGSVSSGIYYWSWIRQPPGKGLEWIGYIYYSGSTNYNPSLKSRVTISVDTSKNQFSLKLSSVTAADTAVYYCARDYYVSGNYYNVDYYFFGVDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 225 - protein, 109 aa, Artificial Sequence
  Variable light (vl) domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPLFTFGPGTKVDIK

SEQ ID NO: 226 - protein, 6 aa, Artificial Sequence
  vlCDR1
QSVSSY

SEQ ID NO: 227 - protein, 3 aa, Artificial Sequence
  vlCDR2
DAS

SEQ ID NO: 228 - protein, 11 aa, Artificial Sequence
  vlCDR3
QQRSNWPPLFT

SEQ ID NO: 229 - protein, 216 aa, Artificial Sequence
  Full length light chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 230 - protein, 119 aa, Artificial Sequence
  CHA.9.536.1 Variable heavy (vh) domain
QVQLVQSGAEVKKPGASVKVSCKASGYTFTEYTLHWVRQAPGQGLEWMGGINPNNGGTSYAQKFQGRVTMTRDTSTSTVYMELSSLRSEDTAVYYCARSGYYDYSFAYWGQGTLVTVSS

SEQ ID NO: 231 - protein, 10 aa, Artificial Sequence
  vhCDR1
GYTFTEYTLH

SEQ ID NO: 232 - protein, 10 aa, Artificial Sequence
  vhCDR2
GINPNNGGTS

SEQ ID NO: 233 - protein, 10 aa, Artificial Sequence
  vhCDR3
SGYYDYSFAY

SEQ ID NO: 234 - protein, 446 aa, Artificial Sequence
  Full length HC (IgG4(S241P))
QVQLVQSGAEVKKPGASVKVSCKASGYTFTEYTLHWVRQAPGQGLEWMGGINPNNGGTSYAQKFQGRVTMTRDTSTSTVYMELSSLRSEDTAVYYCARSGYYDYSFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 235 - protein, 107 aa, Artificial Sequence
  Variable light (vl) domain
DIQMTQSPSSLSASVGDRVTITCRASQDVKNAVVWYQQKPGKAPKLLIYSPSYRYTGVPSRFSGSGSGTDFTLTISSLQPEDFATYYCQQHYSTPFTFGQGTKLEIK

SEQ ID NO: 236 - protein, 11 aa, Artificial Sequence
  vlCDR1
RASQDVKNAVV

SEQ ID NO: 237 - protein, 7 aa, Artificial Sequence
  vlCDR2
SPSYRYT

SEQ ID NO: 238 - protein, 9 aa, Artificial Sequence
  vlCDR3
QQHYSTPFT

SEQ ID NO: 239 - protein, 214 aa, Artificial Sequence
  Full length light chain
DIQMTQSPSSLSASVGDRVTITCRASQDVKNAVVWYQQKPGKAPKLLIYSPSYRYTGVPSRFSGSGSGTDFTLTISSLQPEDFATYYCQQHYSTPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 240 - protein, 119 aa, Artificial Sequence
  CHA.9.536.3 Variable heavy (vh) domain
QVQLVQSGAEVKKPGASVKVSCKTSGYTFTEYTLHWVRQAPGQGLEWIGGINPNNGGTSYAQKFQGRVTMTVDTSTSTVYMELSSLRSEDTAVYYCAGSGYYDYSFAYWGQGTLVTVSS

SEQ ID NO: 241 - protein, 10 aa, Artificial Sequence
  vhCDR1
GYTFTEYTLH

SEQ ID NO: 242 - protein, 10 aa, Artificial Sequence
  vhCDR2
GINPNNGGTS

SEQ ID NO: 243 - protein, 10 aa, Artificial Sequence
  vhCDR3
SGYYDYSFAY

SEQ ID NO: 244 - protein, 446 aa, Artificial Sequence
  Full length HC (IgG4(S241P))
QVQLVQSGAEVKKPGASVKVSCKTSGYTFTEYTLHWVRQAPGQGLEWIGGINPNNGGTSYAQKFQGRVTMTVDTSTSTVYMELSSLRSEDTAVYYCAGSGYYDYSFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 245 - protein, 107 aa, Artificial Sequence; identical to SEQ ID NO: 235
  Variable light (vl) domain

SEQ ID NO: 246 - protein, 11 aa, Artificial Sequence
  vlCDR1
RASQDVKNAVV

SEQ ID NO: 247 - protein, 7 aa, Artificial Sequence
  vlCDR2
SPSYRYT

SEQ ID NO: 248 - protein, 9 aa, Artificial Sequence
  vlCDR3
QQHYSTPFT

SEQ ID NO: 249 - protein, 214 aa, Artificial Sequence; identical to SEQ ID NO: 239
  Full length light chain

SEQ ID NO: 250 - protein, 119 aa, Artificial Sequence; identical to SEQ ID NO: 240
  CHA.9.536.4 Variable heavy (vh) domain

SEQ ID NO: 251 - protein, 10 aa, Artificial Sequence
  vhCDR1
GYTFTEYTLH

SEQ ID NO: 252 - protein, 10 aa, Artificial Sequence
  vhCDR2
GINPNNGGTS

SEQ ID NO: 253 - protein, 10 aa, Artificial Sequence
  vhCDR3
SGYYDYSFAY

SEQ ID NO: 254 - protein, 446 aa, Artificial Sequence; identical to SEQ ID NO: 244
  Full length HC (IgG4(S241P))

SEQ ID NO: 255 - protein, 107 aa, Artificial Sequence
  Variable light (vl) domain
DIQMTQSPSSLSASVGDRVTITCRASQDVKNAVVWYQQKPGKAPKLLIYSPSYRYTGVPSRFSGSGSGTDFTFTISSVQPEDFATYYCQQHYSTPFTFGQGTKLEIK

SEQ ID NO: 256 - protein, 11 aa, Artificial Sequence
  vlCDR1
RASQDVKNAVV

SEQ ID NO: 257 - protein, 7 aa, Artificial Sequence
  vlCDR2
SPSYRYT

SEQ ID NO: 258 - protein, 9 aa, Artificial Sequence
  vlCDR3
QQHYSTPFT

SEQ ID NO: 259 - protein, 214 aa, Artificial Sequence
  Full length light chain
DIQMTQSPSSLSASVGDRVTITCRASQDVKNAVVWYQQKPGKAPKLLIYSPSYRYTGVPSRFSGSGSGTDFTFTISSVQPEDFATYYCQQHYSTPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 260 - protein, 119 aa, Artificial Sequence
  CHA.9.536.5 Variable heavy (vh) domain
QVQLVQSGAEVKKPGASVKISCKTSGYTFTEYTLHWVRQAPGQGLEWIGGINPNNGGTSYAQKFQGRATLTVDTSTSTAYMELSSLRSEDTAVYYCAGSGYYDYSFAYWGQGTLVTVSS

SEQ ID NO: 261 - protein, 10 aa, Artificial Sequence
  vhCDR1
GYTFTEYTLH

SEQ ID NO: 262 - protein, 10 aa, Artificial Sequence
  vhCDR2
GINPNNGGTS

SEQ ID NO: 263 - protein, 10 aa, Artificial Sequence
  vhCDR3
SGYYDYSFAY

SEQ ID NO: 264 - protein, 446 aa, Artificial Sequence
  Full length HC (IgG4(S241P))
QVQLVQSGAEVKKPGASVKISCKTSGYTFTEYTLHWVRQAPGQGLEWIGGINPNNGGTSYAQKFQGRATLTVDTSTSTAYMELSSLRSEDTAVYYCAGSGYYDYSFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 265 - protein, 107 aa, Artificial Sequence; identical to SEQ ID NO: 235
  Variable light (vl) domain

SEQ ID NO: 266 - protein, 11 aa, Artificial Sequence
  vlCDR1
RASQDVKNAVV

SEQ ID NO: 267 - protein, 7 aa, Artificial Sequence
  vlCDR2
SPSYRYT

SEQ ID NO: 268 - protein, 9 aa, Artificial Sequence
  vlCDR3
QQHYSTPFT

SEQ ID NO: 269 - protein, 214 aa, Artificial Sequence; identical to SEQ ID NO: 239
  Full length light chain

SEQ ID NO: 270 - protein, 119 aa, Artificial Sequence; identical to SEQ ID NO: 260
  CHA.9.536.6 Variable heavy (vh) domain

SEQ ID NO: 271 - protein, 10 aa, Artificial Sequence
  vhCDR1
GYTFTEYTLH

SEQ ID NO: 272 - protein, 10 aa, Artificial Sequence
  vhCDR2
GINPNNGGTS

SEQ ID NO: 273 - protein, 10 aa, Artificial Sequence
  vhCDR3
SGYYDYSFAY

SEQ ID NO: 274 - protein, 446 aa, Artificial Sequence; identical to SEQ ID NO: 264
  Full length HC (IgG4(S241P))

SEQ ID NO: 275 - protein, 107 aa, Artificial Sequence; identical to SEQ ID NO: 255
  Variable light (vl) domain

SEQ ID NO: 276 - protein, 11 aa, Artificial Sequence
  vlCDR1
RASQDVKNAVV

SEQ ID NO: 277 - protein, 7 aa, Artificial Sequence
  vlCDR2
SPSYRYT

SEQ ID NO: 278 - protein, 9 aa, Artificial Sequence
  vlCDR3
QQHYSTPFT

SEQ ID NO: 279 - protein, 214 aa, Artificial Sequence; identical to SEQ ID NO: 259
  Full length light chain

SEQ ID NO: 280 - protein, 119 aa, Artificial Sequence
  CHA.9.536.7 Variable heavy (vh) domain
QVQLVQSGAEVKKPGASVKISCKTSGYTFTEYTLHWVRQAPGQGLEWIGGINPNNGGTSYAQKFQGRATLTVDKSTSTAYMELSSLRSEDTAVYYCAGSGYYDYSFAYWGQGTLVTVSS

SEQ ID NO: 281 - protein, 10 aa, Artificial Sequence
  vhCDR1
GYTFTEYTLH

SEQ ID NO: 282 - protein, 10 aa, Artificial Sequence
  vhCDR2
GINPNNGGTS

SEQ ID NO: 283 - protein, 10 aa, Artificial Sequence
  vhCDR3
SGYYDYSFAY

SEQ ID NO: 284 - protein, 446 aa, Artificial Sequence
  Full length HC (IgG4(S241P))
QVQLVQSGAEVKKPGASVKISCKTSGYTFTEYTLHWVRQAPGQGLEWIGGINPNNGGTSYAQKFQGRATLTVDKSTSTAYMELSSLRSEDTAVYYCAGSGYYDYSFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 285 - protein, 107 aa, Artificial Sequence; identical to SEQ ID NO: 235
  Variable light (vl) domain

SEQ ID NO: 286 - protein, 11 aa, Artificial Sequence
  vlCDR1
RASQDVKNAVV

SEQ ID NO: 287 - protein, 7 aa, Artificial Sequence
  vlCDR2
SPSYRYT

SEQ ID NO: 288 - protein, 9 aa, Artificial Sequence
  vlCDR3
QQHYSTPFT

SEQ ID NO: 289 - protein, 214 aa, Artificial Sequence; identical to SEQ ID NO: 239
  Full length light chain

SEQ ID NO: 290 - protein, 119 aa, Artificial Sequence; identical to SEQ ID NO: 280
  CHA.9.536.8 Variable heavy (vh) domain

SEQ ID NO: 291 - protein, 10 aa, Artificial Sequence
  vhCDR1
GYTFTEYTLH

SEQ ID NO: 292 - protein, 10 aa, Artificial Sequence
  vhCDR2
GINPNNGGTS

SEQ ID NO: 293 - protein, 10 aa, Artificial Sequence
  vhCDR3
SGYYDYSFAY

SEQ ID NO: 294 - protein, 446 aa, Artificial Sequence; identical to SEQ ID NO: 284
  Full length HC (IgG4(S241P))

SEQ ID NO: 295 - protein, 107 aa, Artificial Sequence; identical to SEQ ID NO: 255
  Variable light (vl) domain

SEQ ID NO: 296 - protein, 11 aa, Artificial Sequence
  vlCDR1
RASQDVKNAVV

SEQ ID NO: 297 - protein, 7 aa, Artificial Sequence
  vlCDR2
SPSYRYT

SEQ ID NO: 298 - protein, 9 aa, Artificial Sequence
  vlCDR3
QQHYSTPFT

SEQ ID NO: 299 - protein, 214 aa, Artificial Sequence; identical to SEQ ID NO: 259
  Full length light chain

SEQ ID NO: 300 - protein, 119 aa, Artificial Sequence
  CHA.9.560.1 Variable heavy (vh) domain
QVQLVQSGAEVKKPGASVKVSCKASGYTFTNYGMNWVRQAPGQGLEWMGWINTYTGEPTYAQKFQGRVTMTRDTSTSTVYMELSSLRSEDTAVYYCARGNGYYVGMDYWGQGTLVTVSS

SEQ ID NO: 301 - protein, 10 aa, Artificial Sequence
  vhCDR1
GYTFTNYGMN

SEQ ID NO: 302 - protein, 10 aa, Artificial Sequence
  vhCDR2
WINTYTGEPT

SEQ ID NO: 303 - protein, 10 aa, Artificial Sequence
  vhCDR3
GNGYYVGMDY

SEQ ID NO: 304 - protein, 446 aa, Artificial Sequence
  Full length HC (IgG4(S241P))
QVQLVQSGAEVKKPGASVKVSCKASGYTFTNYGMNWVRQAPGQGLEWMGWINTYTGEPTYAQKFQGRVTMTRDTSTSTVYMELSSLRSEDTAVYYCARGNGYYVGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 305 - protein, 109 aa, Artificial Sequence
  Variable light (vl) domain
QAVVTQEPSLTVSPGGTVTLTCRSSTGAVTTSNHANWFQQKPGQAPRTLIYGTNGRGSWTPARFSGSLLGGKAALTLSGAQPEDEAEYYCALWFSNHWVFGGGTKLTVL

SEQ ID NO: 306 - protein, 14 aa, Artificial Sequence
  vlCDR1
RSSTGAVTTSNHAN

SEQ ID NO: 307 - protein, 7 aa, Artificial Sequence
  vlCDR2
GTNGRGS

SEQ ID NO: 308 - protein, 9 aa, Artificial Sequence
  vlCDR3
ALWFSNHWV

SEQ ID NO: 309 - protein, 214 aa, Artificial Sequence
  Full length light chain
QAVVTQEPSLTVSPGGTVTLTCRSSTGAVTTSNHANWFQQKPGQAPRTLIYGTNGRGSWTPARFSGSLLGGKAALTLSGAQPEDEAEYYCALWFSNHWVFGGGTKLTVLQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 310 - protein, 119 aa, Artificial Sequence
  CHA.9.560.3 Variable heavy (vh) domain
QVQLVQSGAEVKKPGASVKVSCKASGYTFTNYGMNWVRQAPGQGLEWMGWINTYTGEPTYAQKFQGRVTMTLDTSTSTAYMELSSLRSEDTAVYYCSRGNGYYVGMDYWGQGTLVTVSS

SEQ ID NO: 311 - protein, 10 aa, Artificial Sequence
  vhCDR1
GYTFTNYGMN

SEQ ID NO: 312 - protein, 10 aa, Artificial Sequence
  vhCDR2
WINTYTGEPT

SEQ ID NO: 313 - protein, 10 aa, Artificial Sequence
  vhCDR3
GNGYYVGMDY

SEQ ID NO: 314 - protein, 446 aa, Artificial Sequence
  Full length HC (IgG4(S241P))
QVQLVQSGAEVKKPGASVKVSCKASGYTFTNYGMNWVRQAPGQGLEWMGWINTYTGEPTYAQKFQGRVTMTLDTSTSTAYMELSSLRSEDTAVYYCSRGNGYYVGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 315 - protein, 109 aa, Artificial Sequence
  Variable light (vl) domain
QAVVTQEPSLTVSPGGTVTLTCGSSTGAVTTSNHANWVQQKPGQAFRGLIRGTNGRGSWTPARFSGSLLGGKAALTISGAQPEDEAEYYCALWFSNHWVFGGGTKLTVL

SEQ ID NO: 316 - protein, 14 aa, Artificial Sequence
  vlCDR1
GSSTGAVTTSNHAN

SEQ ID NO: 317 - protein, 7 aa, Artificial Sequence
  vlCDR2
GTNGRGS

SEQ ID NO: 318 - protein, 9 aa, Artificial Sequence
  vlCDR3
ALWFSNHWV

SEQ ID NO: 319 - protein, 214 aa, Artificial Sequence
  Full length light chain
QAVVTQEPSLTVSPGGTVTLTCGSSTGAVTTSNHANWVQQKPGQAFRGLIRGTNGRGSWTPARFSGSLLGGKAALTISGAQPEDEAEYYCALWFSNHWVFGGGTKLTVLQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 320 - protein, 119 aa, Artificial Sequence; identical to SEQ ID NO: 310
  CHA.9.560.4 Variable heavy (vh) domain

SEQ ID NO: 321 - protein, 10 aa, Artificial Sequence
  vhCDR1
GYTFTNYGMN

SEQ ID NO: 322 - protein, 10 aa, Artificial Sequence
  vhCDR2
WINTYTGEPT

SEQ ID NO: 323 - protein, 10 aa, Artificial Sequence
  vhCDR3
GNGYYVGMDY

SEQ ID NO: 324 - protein, 446 aa, Artificial Sequence; identical to SEQ ID NO: 314
  Full length HC (IgG4(S241P))

SEQ ID NO: 325 - protein, 109 aa, Artificial Sequence
  Variable light (vl) domain
QAVVTQEPSLTVSPGGTVTLTCGSSTGAVTTSNHANWVQQKPGQAFRGLIRGTNGRGSGVPARFSGSLLGGKAALTISGAQPEDEAEYYCALWFSNHWVFGGGTKLTVL

SEQ ID NO: 326 - protein, 14 aa, Artificial Sequence
  vlCDR1
GSSTGAVTTSNHAN

SEQ ID NO: 327 - protein, 7 aa, Artificial Sequence
  vlCDR2
GTNGRGS

SEQ ID NO: 328 - protein, 9 aa, Artificial Sequence
  vlCDR3
ALWFSNHWV

SEQ ID NO: 329 - protein, 214 aa, Artificial Sequence
  Full length light chain
QAVVTQEPSLTVSPGGTVTLTCGSSTGAVTTSNHANWVQQKPGQAFRGLIRGTNGRGSGVPARFSGSLLGGKAALTISGAQPEDEAEYYCALWFSNHWVFGGGTKLTVLQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 330 - protein, 119 aa, Artificial Sequence
  CHA.9.560.5 Variable heavy (vh) domain
QVQLVQSGAEVKKPGASVKISCKASGYTFTNYGMNWVRQAPGQGLEWMGWINTYTGEPTYAQKFQGRFTFTLDTSTSTAYLEISSLRSEDTAVYYCSRGNGYYVGMDYWGQGTLVTVSS

SEQ ID NO: 331 - protein, 10 aa, Artificial Sequence
  vhCDR1
GYTFTNYGMN

SEQ ID NO: 332 - protein, 10 aa, Artificial Sequence
  vhCDR2
WINTYTGEPT

SEQ ID NO: 333 - protein, 10 aa, Artificial Sequence
  vhCDR3
GNGYYVGMDY

SEQ ID NO: 334 - protein, 446 aa, Artificial Sequence
  Full length HC (IgG4(S241P))
QVQLVQSGAEVKKPGASVKISCKASGYTFTNYGMNWVRQAPGQGLEWMGWINTYTGEPTYAQKFQGRFTFTLDTSTSTAYLEISSLRSEDTAVYYCSRGNGYYVGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 335 - protein, 109 aa, Artificial Sequence; identical to SEQ ID NO: 315
  Variable light (vl) domain

SEQ ID NO: 336 - protein, 14 aa, Artificial Sequence
  vlCDR1
GSSTGAVTTSNHAN

SEQ ID NO: 337 - protein, 7 aa, Artificial Sequence
  vlCDR2
GTNGRGS

SEQ ID NO: 338 - protein, 9 aa, Artificial Sequence
  vlCDR3
ALWFSNHWV

SEQ ID NO: 339 - protein, 214 aa, Artificial Sequence; identical to SEQ ID NO: 319
  Full length light chain

SEQ ID NO: 340 - protein, 119 aa, Artificial Sequence; identical to SEQ ID NO: 330
  CHA.9.560.6 Variable heavy (vh) domain

SEQ ID NO: 341 - protein, 10 aa, Artificial Sequence
  vhCDR1
GYTFTNYGMN

SEQ ID NO: 342 - protein, 10 aa, Artificial Sequence
  vhCDR2
WINTYTGEPT

SEQ ID NO: 343 - protein, 10 aa, Artificial Sequence
  vhCDR3
GNGYYVGMDY

SEQ ID NO: 344 - protein, 446 aa, Artificial Sequence; identical to SEQ ID NO: 334
  Full length HC (IgG4(S241P))

SEQ ID NO: 345 - protein, 109 aa, Artificial Sequence; identical to SEQ ID NO: 325
  Variable light (vl) domain

SEQ ID NO: 346 - protein, 14 aa, Artificial Sequence
  vlCDR1
GSSTGAVTTSNHAN

SEQ ID NO: 347 - protein, 7 aa, Artificial Sequence
  vlCDR2
GTNGRGS

SEQ ID NO: 348 - protein, 9 aa, Artificial Sequence
  vlCDR3
ALWFSNHWV

SEQ ID NO: 349 - protein, 214 aa, Artificial Sequence; identical to SEQ ID NO: 329
  Full length light chain

SEQ ID NO: 350 - protein, 119 aa, Artificial Sequence
  CHA.9.560.7 Variable heavy (vh) domain
QVQLVQSGAEVKKPGASVKISCKASGYTFTNYGMNWVRQAPGQGLEWMGWINTYTGEPTYAQKFQGRFTFTLDASTSTAYLEISSLRSEDTAVYYCSRGNGYYVGMDYWGQGTLVTVSS

SEQ ID NO: 351 - protein, 10 aa, Artificial Sequence
  vhCDR1
GYTFTNYGMN

SEQ ID NO: 352 - protein, 10 aa, Artificial Sequence
  vhCDR2
WINTYTGEPT

SEQ ID NO: 353 - protein, 10 aa, Artificial Sequence
  vhCDR3
GNGYYVGMDY

SEQ ID NO: 354 - protein, 446 aa, Artificial Sequence; identical to SEQ ID NO: 334
  Full length HC (IgG4(S241P))

SEQ ID NO: 355 - protein, 109 aa, Artificial Sequence; identical to SEQ ID NO: 315
  Variable light (vl) domain

SEQ ID NO: 356 - protein, 14 aa, Artificial Sequence
  vlCDR1
GSSTGAVTTSNHAN

SEQ ID NO: 357 - protein, 7 aa, Artificial Sequence
  vlCDR2
GTNGRGS

SEQ ID NO: 358 - protein, 9 aa, Artificial Sequence
  vlCDR3
ALWFSNHWV

SEQ ID NO: 359 - protein, 214 aa, Artificial Sequence; identical to SEQ ID NO: 319
  Full length light chain

SEQ ID NO: 360 - protein, 119 aa, Artificial Sequence; identical to SEQ ID NO: 350
  CHA.9.560.8 Variable heavy (vh) domain

SEQ ID NO: 361 - protein, 10 aa, Artificial Sequence
  vhCDR1
GYTFTNYGMN

SEQ ID NO: 362 - protein, 10 aa, Artificial Sequence
  vhCDR2
WINTYTGEPT

SEQ ID NO: 363 - protein, 10 aa, Artificial Sequence
  vhCDR3
GNGYYVGMDY

SEQ ID NO: 364 - protein, 446 aa, Artificial Sequence
  Full length HC (IgG4(S241P))
QVQLVQSGAEVKKPGASVKISCKASGYTFTNYGMNWVRQAPGQGLEWMGWINTYTGEPTYAQKFQGRFTFTLDASTSTAYLEISSLRSEDTAVYYCSRGNGYYVGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 365 - protein, 109 aa, Artificial Sequence; identical to SEQ ID NO: 325
  Variable light (vl) domain

SEQ ID NO: 366 - protein, 14 aa, Artificial Sequence
  vlCDR1
GSSTGAVTTSNHAN

SEQ ID NO: 367 - protein, 7 aa, Artificial Sequence
  vlCDR2
GTNGRGS

SEQ ID NO: 368 - protein, 9 aa, Artificial Sequence
  vlCDR3
ALWFSNHWV

SEQ ID NO: 369 - protein, 214 aa, Artificial Sequence; identical to SEQ ID NO: 329
  Full length light chain

SEQ ID NO: 370 - protein, 119 aa, Artificial Sequence
  CHA.9.546.1 Variable heavy (vh) domain
EVQLVESGGGLVQPGGSLRLSCAASGFTFSSYIMSWVRQAPGKGLEWVSTISGGGTNTYYADSVKGRFTISRDNSKNTLYLQMNSLRAEDTAVYYCARWLLSYYAMDYWGQGTLVTVSS

SEQ ID NO: 371 - protein, 10 aa, Artificial Sequence
  vhCDR1
GFTFSSYIMS

SEQ ID NO: 372 - protein, 10 aa, Artificial Sequence
  vhCDR2
TISGGGTNTY

SEQ ID NO: 373 - protein, 10 aa, Artificial Sequence
  vhCDR3
WLLSYYAMDY

SEQ ID NO: 374 - protein, 446 aa, Artificial Sequence
  Full length HC (IgG4(S241P))
EVQLVESGGGLVQPGGSLRLSCAASGFTFSSYIMSWVRQAPGKGLEWVSTISGGGTNTYYADSVKGRFTISRDNSKNTLYLQMNSLRAEDTAVYYCARWLLSYYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 375 - protein, 107 aa, Artificial Sequence
  Variable light (vl) domain
DIQMTQSPSSLSASVGDRVTITCRASQNINVWLTWYQQKPGKAPKLLIYKASNLHTGVPSRFSGSGSGTDFTLTISSLQPEDFATYYCQQGQSYPYTFGQGTKLEIK

SEQ ID NO: 376 - protein, 11 aa, Artificial Sequence
  vlCDR1
RASQNINVWLT

SEQ ID NO: 377 - protein, 7 aa, Artificial Sequence
  vlCDR2
KASNLHT

SEQ ID NO: 378 - protein, 9 aa, Artificial Sequence
  vlCDR3
QQGQSYPYT

SEQ ID NO: 379 - protein, 214 aa, Artificial Sequence
  Full length light chain
DIQMTQSPSSLSASVGDRVTITCRASQNINVWLTWYQQKPGKAPKLLIYKASNLHTGVPSRFSGSGSGTDFTLTISSLQPEDFATYYCQQGQSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 380 - protein, 119 aa, Artificial Sequence
  CHA.9.547.1 Variable heavy (vh) domain
EVQLVESGGGLVQPGGSLRLSCAASGFTFSSYIMSWVRQAPGKGLEWVSTISGGGTNTYYADSVKGRFTISRDNSKNTLYLQMNSLRAEDTAVYYCAKWLLSYYAMDYWGQGTLVTVSS

SEQ ID NO: 381 - protein, 10 aa, Artificial Sequence
  vhCDR1
GFTFSSYIMS

SEQ ID NO: 382 - protein, 10 aa, Artificial Sequence
  vhCDR2
TISGGGTNTY

SEQ ID NO: 383 - protein, 10 aa, Artificial Sequence
  vhCDR3
WLLSYYAMDY

SEQ ID NO: 384 - protein, 446 aa, Artificial Sequence
  Full length HC (IgG4(S241P))
EVQLVESGGGLVQPGGSLRLSCAASGFTFSSYIMSWVRQAPGKGLEWVSTISGGGTNTYYADSVKGRFTISRDNSKNTLYLQMNSLRAEDTAVYYCAKWLLSYYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 385 - protein, 107 aa, Artificial Sequence; identical to SEQ ID NO: 375
  Variable light (vl) domain

SEQ ID NO: 386 - protein, 11 aa, Artificial Sequence
  vlCDR1
RASQNINVWLT

SEQ ID NO: 387 - protein, 7 aa, Artificial Sequence
  vlCDR2
KASNLHT

SEQ ID NO: 388 - protein, 9 aa, Artificial Sequence
  vlCDR3
QQGQSYPYT

SEQ ID NO: 389 - protein, 214 aa, Artificial Sequence; identical to SEQ ID NO: 379
  Full length light chain

SEQ ID NO: 390 - protein, 119 aa, Artificial Sequence
  CHA.9.547.2 Variable heavy (vh) domain
EVQLVESGGGLVQPGGSLRLSCAASGFTFSSYIMSWVRQAPGKGLEWVATISGGGTNTYYADSVKGRFTISRDNSKNTLYLQMNSLRAEDTAVYYCAKWLLSYYAMDYWGQGTLVTVSS

SEQ ID NO: 391 - protein, 10 aa, Artificial Sequence
  vhCDR1
GFTFSSYIMS

SEQ ID NO: 392 - protein, 10 aa, Artificial Sequence
  vhCDR2
TISGGGTNTY

SEQ ID NO: 393 - protein, 10 aa, Artificial Sequence
  vhCDR3
WLLSYYAMDY

SEQ ID NO: 394 - protein, 446 aa, Artificial Sequence
  Full length HC (IgG4(S241P))
EVQLVESGGGLVQPGGSLRLSCAASGFTFSSYIMSWVRQAPGKGLEWVATISGGGTNTYYADSVKGRFTISRDNSKNTLYLQMNSLRAEDTAVYYCAKWLLSYYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 395 - protein, 107 aa, Artificial Sequence; identical to SEQ ID NO: 375
  Variable light (vl) domain

SEQ ID NO: 396 - protein, 11 aa, Artificial Sequence
  vlCDR1
RASQNINVWLT

SEQ ID NO: 397 - protein, 7 aa, Artificial Sequence
  vlCDR2
KASNLHT

SEQ ID NO: 398 - protein, 9 aa, Artificial Sequence
  vlCDR3
QQGQSYPYT

SEQ ID NO: 399 - protein, 214 aa, Artificial Sequence; identical to SEQ ID NO: 379
  Full length light chain

SEQ ID NO: 400 - protein, 119 aa, Artificial Sequence; identical to SEQ ID NO: 380
  CHA.9.547.3 Variable heavy (vh) domain

SEQ ID NO: 401 - protein, 10 aa, Artificial Sequence
  vhCDR1
GFTFSSYIMS

SEQ ID NO: 402 - protein, 10 aa, Artificial Sequence
  vhCDR2
TISGGGTNTY

SEQ ID NO: 403 - protein, 10 aa, Artificial Sequence
  vhCDR3
WLLSYYAMDY

SEQ ID NO: 404 - protein, 446 aa, Artificial Sequence; identical to SEQ ID NO: 384
  Full length HC (IgG4(S241P))

SEQ ID NO: 405 - protein, 107 aa, Artificial Sequence
  Variable light (vl) domain
DIQMTQSPSSLSASVGDRITITCRASQNINVWLTWYQQKPGKAPKLLIYKASNLHTGVPSRFSGSGSGTDFTLTISSLQPEDFATYYCQQGQSYPYTFGQGTKLEIK

SEQ ID NO: 406 - protein, 11 aa, Artificial Sequence
  vlCDR1
RASQNINVWLT

SEQ ID NO: 407 - protein, 7 aa, Artificial Sequence
  vlCDR2
KASNLHT

SEQ ID NO: 408 - protein, 9 aa, Artificial Sequence
  vlCDR3
QQGQSYPYT

SEQ ID NO: 409 - protein, 214 aa, Artificial Sequence
  Full length light chain
DIQMTQSPSSLSASVGDRITITCRASQNINVWLTWYQQKPGKAPKLLIYKASNLHTGVPSRFSGSGSGTDFTLTISSLQPEDFATYYCQQGQSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 410 - protein, 119 aa, Artificial Sequence; identical to SEQ ID NO: 390
  CHA.9.547.4 Variable heavy (vh) domain

SEQ ID NO: 411 - protein, 10 aa, Artificial Sequence
  vhCDR1
GFTFSSYIMS

SEQ ID NO: 412 - protein, 10 aa, Artificial Sequence
  vhCDR2
TISGGGTNTY

SEQ ID NO: 413 - protein, 10 aa, Artificial Sequence
  vhCDR3
WLLSYYAMDY

SEQ ID NO: 414 - protein, 446 aa, Artificial Sequence; identical to SEQ ID NO: 394
  Full length HC (IgG4(S241P))

SEQ ID NO: 415 - protein, 107 aa, Artificial Sequence; identical to SEQ ID NO: 405
  Variable light (vl) domain

SEQ ID NO: 416 - protein, 11 aa, Artificial Sequence
  vlCDR1
RASQNINVWLT

SEQ ID NO: 417 - protein, 7 aa, Artificial Sequence
  vlCDR2
KASNLHT

SEQ ID NO: 418 - protein, 9 aa, Artificial Sequence
  vlCDR3
QQGQSYPYT

SEQ ID NO: 419 - protein, 214 aa, Artificial Sequence; identical to SEQ ID NO: 409
  Full length light chain

SEQ ID NO: 420 - protein, 119 aa, Artificial Sequence; identical to SEQ ID NO: 380
  CHA.9.547.6 Variable heavy (vh) domain

SEQ ID NO: 421 - protein, 10 aa, Artificial Sequence
  vhCDR1
GFTFSSYIMS

SEQ ID NO: 422 - protein, 10 aa, Artificial Sequence
  vhCDR2
TISGGGTNTY

SEQ ID NO: 423 - protein, 10 aa, Artificial Sequence
  vhCDR3
WLLSYYAMDY

SEQ ID NO: 424 - protein, 446 aa, Artificial Sequence; identical to SEQ ID NO: 384
  Full length HC (IgG4(S241P))

SEQ ID NO: 425 - protein, 107 aa, Artificial Sequence
  Variable light (vl) domain
DIQMTQSPSSLSASVGDRVTITCRASQNINVWLTWYQQKPGKAPKLLIYKASKSHTGVPSRFSGSGSGTDFTLTISSLQPEDFATYYCQQGQSYPYTFGQGTKLEIK

SEQ ID NO: 426 - protein, 11 aa, Artificial Sequence
  vlCDR1
RASQNINVWLT

SEQ ID NO: 427 - protein, 7 aa, Artificial Sequence
  vlCDR2
KASKSHT

SEQ ID NO: 428 - protein, 9 aa, Artificial Sequence
  vlCDR3
QQGQSYPYT

SEQ ID NO: 429 - protein, 214 aa, Artificial Sequence
  Full length light chain
DIQMTQSPSSLSASVGDRVTITCRASQNINVWLTWYQQKPGKAPKLLIYKASKSHTGVPSRFSGSGSGTDFTLTISSLQPEDFATYYCQQGQSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 430 - protein, 119 aa, Artificial Sequence; identical to SEQ ID NO: 390
  CHA.9.547.7 Variable heavy (vh) domain

SEQ ID NO: 431 - protein, 10 aa, Artificial Sequence
  vhCDR1
GFTFSSYIMS

SEQ ID NO: 432 - protein, 10 aa, Artificial Sequence
  vhCDR2
TISGGGTNTY

SEQ ID NO: 433 - protein, 10 aa, Artificial Sequence
  vhCDR3
WLLSYYAMDY

SEQ ID NO: 434 - protein, 446 aa, Artificial Sequence; identical to SEQ ID NO: 394
  Full length HC (IgG4(S241P))

SEQ ID NO: 435 - protein, 107 aa, Artificial Sequence; identical to SEQ ID NO: 425
  Variable light (vl) domain

SEQ ID NO: 436 - protein, 11 aa, Artificial Sequence
  vlCDR1
RASQNINVWLT

SEQ ID NO: 437 - protein, 7 aa, Artificial Sequence
  vlCDR2
KASKSHT

SEQ ID NO: 438 - protein, 9 aa, Artificial Sequence
  vlCDR3
QQGQSYPYT

SEQ ID NO: 439 - protein, 214 aa, Artificial Sequence; identical to SEQ ID NO: 429
  Full length light chain

SEQ ID NO: 440 - protein, 119 aa, Artificial Sequence; identical to SEQ ID NO: 380
  CHA.9.547.8 Variable heavy (vh) domain

SEQ ID NO: 441 - protein, 10 aa, Artificial Sequence
  vhCDR1
GFTFSSYIMS

SEQ ID NO: 442 - protein, 10 aa, Artificial Sequence
  vhCDR2
TISGGGTNTY

SEQ ID NO: 443 - protein, 10 aa, Artificial Sequence
  vhCDR3
WLLSYYAMDY

SEQ ID NO: 444 - protein, 446 aa, Artificial Sequence; identical to SEQ ID NO: 384
  Full length HC (IgG4(S241P))

SEQ ID NO: 445 - protein, 107 aa, Artificial Sequence
  Variable light (vl) domain
DIQMTQSPSSLSASVGDRITITCRASQNINVWLTWYQQKPGKAPKLLIYKASKSHTGVPSRFSGSGSGTDFTLTISSLQPEDFATYYCQQGQSYPYTFGQGTKLEIK

SEQ ID NO: 446 - protein, 11 aa, Artificial Sequence
  vlCDR1
RASQNINVWLT

SEQ ID NO: 447 - protein, 7 aa, Artificial Sequence
  vlCDR2
KASKSHT

SEQ ID NO: 448 - protein, 9 aa, Artificial Sequence
  vlCDR3
QQGQSYPYT

SEQ ID NO: 449 - protein, 214 aa, Artificial Sequence
  Full length light chain
DIQMTQSPSSLSASVGDRITITCRASQNINVWLTWYQQKPGKAPKLLIYKASKSHTGVPSRFSGSGSGTDFTLTISSLQPEDFATYYCQQGQSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 450 - protein, 119 aa, Artificial Sequence; identical to SEQ ID NO: 390
  CHA.9.547.9 Variable heavy (vh) domain

SEQ ID NO: 451 - protein, 10 aa, Artificial Sequence
  vhCDR1
GFTFSSYIMS

SEQ ID NO: 452 - protein, 10 aa, Artificial Sequence
  vhCDR2
TISGGGTNTY

SEQ ID NO: 453 - protein, 10 aa, Artificial Sequence
  vhCDR3
WLLSYYAMDY

SEQ ID NO: 454 - protein, 446 aa, Artificial Sequence; identical to SEQ ID NO: 394
  Full length HC (IgG4(S241P))

SEQ ID NO: 455 - protein, 107 aa, Artificial Sequence; identical to SEQ ID NO: 445
  Variable light (vl) domain

SEQ ID NO: 456 - protein, 11 aa, Artificial Sequence
  vlCDR1
RASQNINVWLT

SEQ ID NO: 457 - protein, 7 aa, Artificial Sequence
  vlCDR2
KASKSHT

SEQ ID NO: 458 - protein, 9 aa, Artificial Sequence
  vlCDR3
QQGQSYPYT

SEQ ID NO: 459 - protein, 214 aa, Artificial Sequence; identical to SEQ ID NO: 449
  Full length light chain

SEQ ID NO: 460 - protein, 119 aa, Artificial Sequence
  CHA.9.541.1 Variable heavy (vh) domain
QVQLVQSGAEVKKPGASVKVSCKASGYTITNYGMNWVRQAPGQGLEWMGWINTYTGEPTYAQKFQGRVTMTRDTSTSTVYMELSSLRSEDTAVYYCARGNGNPLGMDYWGQGTLVTVSS

SEQ ID NO: 461 - protein, 10 aa, Artificial Sequence
  vhCDR1
GYTITNYGMN

SEQ ID NO: 462 - protein, 10 aa, Artificial Sequence
  vhCDR2
WINTYTGEPT

SEQ ID NO: 463 - protein, 10 aa, Artificial Sequence
  vhCDR3
GNGNPLGMDY

SEQ ID NO: 464 - protein, 446 aa, Artificial Sequence
  Full length HC (IgG4(S241P))
QVQLVQSGAEVKKPGASVKVSCKASGYTITNYGMNWVRQAPGQGLEWMGWINTYTGEPTYAQKFQGRVTMTRDTSTSTVYMELSSLRSEDTAVYYCARGNGNPLGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 465 - protein, 106 aa, Artificial Sequence
  Variable light (vl) domain
EIVLTQSPATLSLSPGERATLSCGNGNPLGMDYWYQQKPGQAPRLLIYDTSKLASGIPARFSGSGSGTDFTLTISSLEPEDFAVYYCFQGSGYPLTFGQGTKLEIK

SEQ ID NO: 466 - protein, 10 aa, Artificial Sequence
  vlCDR1
GNGNPLGMDY

SEQ ID NO: 467 - protein, 7 aa, Artificial Sequence
  vlCDR2
DTSKLAS

SEQ ID NO: 468 - protein, 9 aa, Artificial Sequence
  vlCDR3
FQGSGYPLT

SEQ ID NO: 469 - protein, 213 aa, Artificial Sequence
  Full length light chain
EIVLTQSPATLSLSPGERATLSCGNGNPLGMDYWYQQKPGQAPRLLIYDTSKLASGIPARFSGSGSGTDFTLTISSLEPEDFAVYYCFQGSGYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 470 - protein, 119 aa, Artificial Sequence
  CHA.9.541.3
QVQLVQSGAEVKKPGASVKVSCKASGYTITNYGMNWVRQAPGQGLEWMGWINTYTGEPTYAQKFQGRFTMTLDTSTSTVYMELSSLRSEDTAVYYCARGNGNPLGMDYWGQGTLVTVSS

SEQ ID NO: 471 - protein, 10 aa, Artificial Sequence
  vhCDR1
GYTITNYGMN

SEQ ID NO: 472 - protein, 10 aa, Artificial Sequence
  vhCDR2
WINTYTGEPT

SEQ ID NO: 473 - protein, 10 aa, Artificial Sequence
  vhCDR3
GNGNPLGMDY

SEQ ID NO: 474 - protein, 446 aa, Artificial Sequence
  Full length HC (IgG4(S241P))
QVQLVQSGAEVKKPGASVKVSCKASGYTITNYGMNWVRQAPGQGLEWMGWINTYTGEPTYAQKFQGRFTMTLDTSTSTVYMELSSLRSEDTAVYYCARGNGNPLGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 475 - protein, 106 aa, Artificial Sequence
  Variable light (vl) domain
EIVLTQSPATLSLSPGERATLSCGNGNPLGMDYWYQQKPGQAPRLLIYDTSKLASGIPARFSGSGSGTDYTLTISSLEPEDFAVYYCFQGSGYPLTFGQGTKLEIK

SEQ ID NO: 476 - protein, 10 aa, Artificial Sequence
  vlCDR1
GNGNPLGMDY

SEQ ID NO: 477 - protein, 7 aa, Artificial Sequence
  vlCDR2
DTSKLAS

SEQ ID NO: 478 - protein, 9 aa, Artificial Sequence
  vlCDR3
FQGSGYPLT

SEQ ID NO: 479 - protein, 213 aa, Artificial Sequence
  Full length light chain
EIVLTQSPATLSLSPGERATLSCGNGNPLGMDYWYQQKPGQAPRLLIYDTSKLASGIPARFSGSGSGTDYTLTISSLEPEDFAVYYCFQGSGYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 480 - protein, 119 aa, Artificial Sequence; identical to SEQ ID NO: 470
  CHA.9.541.4 Variable heavy (vh) domain

SEQ ID NO: 481 - protein, 10 aa, Artificial Sequence
  vhCDR1
GYTITNYGMN

SEQ ID NO: 482 - protein, 10 aa, Artificial Sequence
  vhCDR2
WINTYTGEPT

SEQ ID NO: 483 - protein, 10 aa, Artificial Sequence
  vhCDR3
GNGNPLGMDY

SEQ ID NO: 484 - protein, 446 aa, Artificial Sequence; identical to SEQ ID NO: 474
  Full length HC (IgG4(S241P))

SEQ ID NO: 485 - protein, 106 aa, Artificial Sequence
  Variable light (vl) domain
EIVLTQSPATLSLSPGERATLSCGNGNPLGMDYWYQQKPGQAPRLWIYDTSKLASGVPARFSGSGSGTDYTLTISSLEPEDFAVYYCFQGSGYPLTFGQGTKLEIK

SEQ ID NO: 486 - protein, 10 aa, Artificial Sequence
  vlCDR1
GNGNPLGMDY

SEQ ID NO: 487 - protein, 7 aa, Artificial Sequence
  vlCDR2
DTSKLAS

SEQ ID NO: 488 - protein, 9 aa, Artificial Sequence
  vlCDR3
FQGSGYPLT

SEQ ID NO: 489 - protein, 213 aa, Artificial Sequence
  Full length light chain
EIVLTQSPATLSLSPGERATLSCGNGNPLGMDYWYQQKPGQAPRLWIYDTSKLASGVPARFSGSGSGTDYTLTISSLEPEDFAVYYCFQGSGYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 490 - protein, 119 aa, Artificial Sequence; identical to SEQ ID NO: 470
  CHA.9.541.5 Variable heavy (vh) domain

SEQ ID NO: 491 - protein, 10 aa, Artificial Sequence
  vhCDR1
GYTITNYGMN

SEQ ID NO: 492 - protein, 10 aa, Artificial Sequence
  vhCDR2
WINTYTGEPT

SEQ ID NO: 493 - protein, 10 aa, Artificial Sequence
  vhCDR3
GNGNPLGMDY

SEQ ID NO: 494 - protein, 446 aa, Artificial Sequence; identical to SEQ ID NO: 474
  Full length HC (IgG4(S241P))

SEQ ID NO: 495 - protein, 106 aa, Artificial Sequence
  Variable light (vl) domain
EIVLTQSPATLSLSPGERVTMSCGNGNPLGMDYWYQQKPGQAPRLWIYDTSKLASGVPARFSGSGSGTDYTLTISSMEPEDFAVYYCFQGSGYPLTFGQGTKLEIK

SEQ ID NO: 496 - protein, 10 aa, Artificial Sequence
  vlCDR1
GNGNPLGMDY

SEQ ID NO: 497 - protein, 7 aa, Artificial Sequence
  vlCDR2
DTSKLAS

SEQ ID NO: 498 - protein, 9 aa, Artificial Sequence
  vlCDR3
FQGSGYPLT

SEQ ID NO: 499 - protein, 213 aa, Artificial Sequence
  Full length light chain
EIVLTQSPATLSLSPGERVTMSCGNGNPLGMDYWYQQKPGQAPRLWIYDTSKLASGVPARFSGSGSGTDYTLTISSMEPEDFAVYYCFQGSGYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 500 - protein, 119 aa, Artificial Sequence
  CHA.9.541.6 Variable heavy (vh) domain
QVQLVQSGAEVKKPGASVKISCKASGYTITNYGMNWVRQAPGQGLEWMGWINTYTGEPTYAQKFQGRFTITLDTSTSTVYLEISSLRSEDTAVYYCARGNGNPLGMDYWGQGTLVTVSS

SEQ ID NO: 501 - protein, 10 aa, Artificial Sequence
  vhCDR1
GYTITNYGMN

SEQ ID NO: 502 - protein, 10 aa, Artificial Sequence
  vhCDR2
WINTYTGEPT

SEQ ID NO: 503 - protein, 10 aa, Artificial Sequence
  vhCDR3
GNGNPLGMDY

SEQ ID NO: 504 - protein, 446 aa, Artificial Sequence
  Full length HC (IgG4(S241P))
QVQLVQSGAEVKKPGASVKISCKASGYTITNYGMNWVRQAPGQGLEWMGWINTYTGEPTYAQKFQGRFTITLDTSTSTVYLEISSLRSEDTAVYYCARGNGNPLGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 505 - protein, 106 aa, Artificial Sequence; identical to SEQ ID NO: 475
  Variable light (vl) domain

SEQ ID NO: 506 - protein, 10 aa, Artificial Sequence
  vlCDR1
GNGNPLGMDY

SEQ ID NO: 507 - protein, 7 aa, Artificial Sequence
  vlCDR2
DTSKLAS

SEQ ID NO: 508 - protein, 9 aa, Artificial Sequence
  vlCDR3
FQGSGYPLT

SEQ ID NO: 509 - protein, 213 aa, Artificial Sequence; identical to SEQ ID NO: 479
  Full length light chain

SEQ ID NO: 510 - protein, 119 aa, Artificial Sequence; identical to SEQ ID NO: 500
  CHA.9.541.7 Variable heavy (vh) domain

SEQ ID NO: 511 - protein, 10 aa, Artificial Sequence
  vhCDR1
GYTITNYGMN

SEQ ID NO: 512 - protein, 10 aa, Artificial Sequence
  vhCDR2
WINTYTGEPT

SEQ ID NO: 513 - protein, 10 aa, Artificial Sequence
  vhCDR3
GNGNPLGMDY

SEQ ID NO: 514 - protein, 446 aa, Artificial Sequence; identical to SEQ ID NO: 504
  Full length HC (IgG4(S241P))

SEQ ID NO: 515 - protein, 106 aa, Artificial Sequence; identical to SEQ ID NO: 485
  Variable light (vl) domain

SEQ ID NO: 516 - protein, 10 aa, Artificial Sequence
  vlCDR1
GNGNPLGMDY

SEQ ID NO: 517 - protein, 7 aa, Artificial Sequence
  vlCDR2
DTSKLAS

SEQ ID NO: 518 - protein, 9 aa, Artificial Sequence
  vlCDR3
FQGSGYPLT

SEQ ID NO: 519 - protein, 213 aa, Artificial Sequence; identical to SEQ ID NO: 489
  Full length light chain

SEQ ID NO: 520 - protein, 119 aa, Artificial Sequence; identical to SEQ ID NO: 500
  CHA.9.541.8 Variable heavy (vh) domain

SEQ ID NO: 521 - protein, 10 aa, Artificial Sequence
  vhCDR1
GYTITNYGMN

SEQ ID NO: 522 - protein, 10 aa, Artificial Sequence
  vhCDR2
WINTYTGEPT

SEQ ID NO: 523 - protein, 10 aa, Artificial Sequence
  vhCDR3
GNGNPLGMDY

SEQ ID NO: 524 - protein, 446 aa, Artificial Sequence; identical to SEQ ID NO: 504
  Full length HC (IgG4(S241P))

SEQ ID NO: 525 - protein, 106 aa, Artificial Sequence; identical to SEQ ID NO: 495
  Variable light (vl) domain

SEQ ID NO: 526 - protein, 10 aa, Artificial Sequence
  vlCDR1
GNGNPLGMDY

SEQ ID NO: 527 - protein, 7 aa, Artificial Sequence
  vlCDR2
DTSKLAS

SEQ ID NO: 528 - protein, 9 aa, Artificial Sequence
  vlCDR3
FQGSGYPLT

SEQ ID NO: 529 - protein, 213 aa, Artificial Sequence; identical to SEQ ID NO: 499
  Full length light chain

SEQ ID NO: 530 - protein, 119 aa, Artificial Sequence; identical to SEQ ID NO: 380
  CHA.9.547.10 Variable heavy (vh) domain

SEQ ID NO: 531 - protein, 10 aa, Artificial Sequence
  vhCDR1
GFTFSSYIMS

SEQ ID NO: 532 - protein, 10 aa, Artificial Sequence
  vhCDR2
TISGGGTNTY

SEQ ID NO: 533 - protein, 10 aa, Artificial Sequence
  vhCDR3
WLLSYYAMDY

SEQ ID NO: 534 - protein, 446 aa, Artificial Sequence; identical to SEQ ID NO: 384
  Full length HC

SEQ ID NO: 535 - protein, 107 aa, Artificial Sequence
  Variable light (vl) domain
DIQMTQSPSSLSASVGDRVTITCRASQNINVWLSWYQQKPGKAPKLLIYKASKSHTGVPSRFSGSGSGTDFTLTISSLQPEDFATYYCQQGQSYPYTFGQGTKLEIK

SEQ ID NO: 536 - protein, 11 aa, Artificial Sequence
  vlCDR1
RASQNINVWLS

SEQ ID NO: 537 - protein, 7 aa, Artificial Sequence
  vlCDR2
KASKSHT

SEQ ID NO: 538 - protein, 9 aa, Artificial Sequence
  vlCDR3
QQGQSYPYT

SEQ ID NO: 539 - protein, 214 aa, Artificial Sequence
  Full length light chain
DIQMTQSPSSLSASVGDRVTITCRASQNINVWLSWYQQKPGKAPKLLIYKASKSHTGVPSRFSGSGSGTDFTLTISSLQPEDFATYYCQQGQSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 540 - protein, 119 aa, Artificial Sequence; identical to SEQ ID NO: 380
  CHA.9.547.11 Variable heavy (vh) domain

SEQ ID NO: 541 - protein, 10 aa, Artificial Sequence
  vhCDR1
GFTFSSYIMS

SEQ ID NO: 542 - protein, 10 aa, Artificial Sequence
  vhCDR2
TISGGGTNTY

SEQ ID NO: 543 - protein, 10 aa, Artificial Sequence
  vhCDR3
WLLSYYAMDY

SEQ ID NO: 544 - protein, 446 aa, Artificial Sequence; identical to SEQ ID NO: 384
  Full length HC

SEQ ID NO: 545 - protein, 107 aa, Artificial Sequence
  Variable light (vl) domain
DIQMTQSPSSLSASVGDRITITCRASQNINVWLSWYQQKPGKAPKLLIYKASKSHTGVPSRFSGSGSGTDFTLTISSLQPEDFATYYCQQGQSYPYTFGQGTKLEIK

SEQ ID NO: 546 - protein, 11 aa, Artificial Sequence
  vlCDR1
RASQNINVWLS

SEQ ID NO: 547 - protein, 7 aa, Artificial Sequence
  vlCDR2
KASKSHT

SEQ ID NO: 548 - protein, 9 aa, Artificial Sequence
  vlCDR3
QQGQSYPYT

SEQ ID NO: 549 - protein, 214 aa, Artificial Sequence
  Full length light chain
DIQMTQSPSSLSASVGDRITITCRASQNINVWLSWYQQKPGKAPKLLIYKASKSHTGVPSRFSGSGSGTDFTLTISSLQPEDFATYYCQQGQSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 550 - protein, 119 aa, Artificial Sequence; identical to SEQ ID NO: 390
  CHA.9.547.12 Variable heavy (vh) domain

SEQ ID NO: 551 - protein, 10 aa, Artificial Sequence
  vhCDR1
GFTFSSYIMS

SEQ ID NO: 552 - protein, 10 aa, Artificial Sequence
  vhCDR2
TISGGGTNTY

SEQ ID NO: 553 - protein, 10 aa, Artificial Sequence
  vhCDR3
WLLSYYAMDY

SEQ ID NO: 554 - protein, 446 aa, Artificial Sequence; identical to SEQ ID NO: 394
  Full length HC

SEQ ID NO: 555 - protein, 107 aa, Artificial Sequence; identical to SEQ ID NO: 535
  Variable light (vl) domain

SEQ ID NO: 556 - protein, 11 aa, Artificial Sequence
  vlCDR1
RASQNINVWLS

SEQ ID NO: 557 - protein, 7 aa, Artificial Sequence
  vlCDR2
KASKSHT

SEQ ID NO: 558 - protein, 9 aa, Artificial Sequence
  vlCDR3
QQGQSYPYT

SEQ ID NO: 559 - protein, 214 aa, Artificial Sequence; identical to SEQ ID NO: 539
  Full length light chain

SEQ ID NO: 560 - protein, 119 aa, Artificial Sequence; identical to SEQ ID NO: 390
  CHA.9.547.13 Variable heavy (vh) domain

SEQ ID NO: 561 - protein, 10 aa, Artificial Sequence
  vhCDR1
GFTFSSYIMS

SEQ ID NO: 562 - protein, 10 aa, Artificial Sequence
  vhCDR2
TISGGGTNTY

SEQ ID NO: 563 - protein, 10 aa, Artificial Sequence
  vhCDR3
WLLSYYAMDY

SEQ ID NO: 564 - protein, 446 aa, Artificial Sequence; identical to SEQ ID NO: 394
  Full length HC

SEQ ID NO: 565 - protein, 107 aa, Artificial Sequence; identical to SEQ ID NO: 545
  Variable light (vl) domain

SEQ ID NO: 566 - protein, 11 aa, Artificial Sequence
  vlCDR1
RASQNINVWLS

SEQ ID NO: 567 - protein, 7 aa, Artificial Sequence
  vlCDR2
KASKSHT

SEQ ID NO: 568 - protein, 9 aa, Artificial Sequence
  vlCDR3
QQGQSYPYT

SEQ ID NO: 569 - protein, 214 aa, Artificial Sequence; identical to SEQ ID NO: 549
  Full length light chain

SEQ ID NO: 570 - protein, 117 aa, Artificial Sequence
  CHA.9.543 Variable heavy (vh) domain
EVQLQQSGPELVKPGASMKISCKASGYSFTGYTMNWVRQSHGKNLEWLGLIFPYNGGTSYNQNFKGKATLTVDTSSSTAYMELLSLTSVDSAVYYCARGVRFALDYWGQGTSVSVSS

SEQ ID NO: 571 - protein, 10 aa, Artificial Sequence
  vhCDR1
GYSFTGYTMN

SEQ ID NO: 572 - protein, 10 aa, Artificial Sequence
  vhCDR2
LIFPYNGGTS

SEQ ID NO: 573 - protein, 8 aa, Artificial Sequence
  vhCDR3
GVRFALDY

SEQ ID NO: 574 - protein, 388 aa, Artificial Sequence
  Full length HC
EVQLQQSGPELVKPGASMKISCKASGYSFTGYTMNWVRQSHGKNLEWLGLIFPYNGGTSYNQNFKGKATLTVDTSSSTAYMELLSLTSVDSAVYYCARGVRFALDYWGQGTSVSVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNT

SEQ ID NO: 575 - protein, 112 aa, Artificial Sequence
  Variable light (vl) domain
DVVMTQTPLSLPVSFGDQVSISCRSSQSLANSYGNTYLSWYLHKPGQSPQLLIYEISNRFSGVPDRFSGSGSGTDFTLNISTIKPEDLGMYYCLQGTHQPWTFGGGTKLEIK

SEQ ID NO: 576 - protein, 16 aa, Artificial Sequence
  vlCDR1
RSSQSLANSYGNTYLS

SEQ ID NO: 577 - protein, 7 aa, Artificial Sequence
  vlCDR2
EISNRFS

SEQ ID NO: 578 - protein, 9 aa, Artificial Sequence
  vlCDR3
LQGTHQPWT

SEQ ID NO: 579 - protein, 219 aa, Artificial Sequence
  Full length light chain
DVVMTQTPLSLPVSFGDQVSISCRSSQSLANSYGNTYLSWYLHKPGQSPQLLIYEISNRFSGVPDRFSGSGSGTDFTLNISTIKPEDLGMYYCLQGTHQPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 580 - protein, 119 aa, Artificial Sequence; identical to SEQ ID NO: 210
  Clone 31C6 Variable heavy (vh) domain

SEQ ID NO: 581 - protein, 8 aa, Artificial Sequence
  vhCDR1
GYTFSSYV

SEQ ID NO: 582 - protein, 8 aa, Artificial Sequence
  vhCDR2
IDPYNDGA

SEQ ID NO: 583 - protein, 12 aa, Artificial Sequence
  vhCDR3
ARGGPYGWYFDV

SEQ ID NO: 584 - protein, 443 aa, Artificial Sequence
  Full length HC
EVQLQQSGPELVKPGSSVKMSCKASGYTFSSYVMHWVKQKPGQGLEWIGYIDPYNDGAKYNEKFKGKATLTSDKSSSTAYMELSSLTSEDSAVYYCARGGPYGWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 585 - protein, 107 aa, Artificial Sequence; identical to SEQ ID NO: 215
  Variable light (vl) domain

SEQ ID NO: 586 - protein, 6 aa, Artificial Sequence
  vlCDR1
EHIYSY

SEQ ID NO: 587 - protein, 3 aa, Artificial Sequence
  vlCDR2
NAK

SEQ ID NO: 588 - protein, 9 aa, Artificial Sequence
  vlCDR3
QHHFGSPLT

SEQ ID NO: 589 - protein, 214 aa, Artificial Sequence
  Full length light chain
DIQMTQSPASLSASVGETVTITCRASEHIYSYLSWYQQKQGKSPQLLVYNAKTLAEGVPSRFSGSGSGTQFSLKINSLQPEDFGTYYCQHHFGSPLTFGAGTTLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 590 - protein, 130 aa, Artificial Sequence; identical to SEQ ID NO: 220
  Clone 22G2 Variable heavy (vh) domain

SEQ ID NO: 591 - protein, 10 aa, Artificial Sequence
  vhCDR1
GGSVSSGIYY

SEQ ID NO: 592 - protein, 7 aa, Artificial Sequence
  vhCDR2
IYYSGST

SEQ ID NO: 593 - protein, 22 aa, Artificial Sequence
  vhCDR3
ARDYYVSGNYYNVDYYFFGVDV

SEQ ID NO: 594 - protein, 454 aa, Artificial Sequence
  Full length HC
QVHLQESGPGLVKPSETLSLTCTVSGGSVSSGIYYWSWIRQPPGKGLEWIGYIYYSGSTNYNPSLKSRVTISVDTSKNQFSLKLSSVTAADTAVYYCARDYYVSGNYYNVDYYFFGVDVWGQGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 595 - protein, 109 aa, Artificial Sequence; identical to SEQ ID NO: 225
  Variable light (vl) domain

SEQ ID NO: 596 - protein, 6 aa, Artificial Sequence
  vlCDR1
QSVSSY

SEQ ID NO: 597 - protein, 3 aa, Artificial Sequence
  vlCDR2
DAS

SEQ ID NO: 598 - protein, 11 aa, Artificial Sequence
  vlCDR3
QQRSNWPPLFT

SEQ ID NO: 599 - protein, 216 aa, Artificial Sequence
  Full length light chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPLFTFGPGTKVDIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 600 - protein, 8 aa, Artificial Sequence
  CPA9.086 CDR sequences
GFTFSSYA

SEQ ID NO: 601 - protein, 8 aa, Artificial Sequence
  CPA9.086 CDR sequences
ISYAGEVK

SEQ ID NO: 602 - protein, 14 aa, Artificial Sequence
  CPA9.086 CDR sequences
ARDPLPLHYYGMDV

SEQ ID NO: 603 - protein, 8 aa, Artificial Sequence
  CPA9.086 CDR sequences
SSNMGRRP

SEQ ID NO: 604 - protein, 3 aa, Artificial Sequence
  CPA9.086 CDR sequences
SQN

SEQ ID NO: 605 - protein, 11 aa, Artificial Sequence
  CPA9.086 CDR sequences
AVWDDIGRVLQ

SEQ ID NO: 606 - protein, 5 aa, Artificial Sequence
  CPA9.086 CDR sequences
SYAMH

SEQ ID NO: 607 - protein, 17 aa, Artificial Sequence
  CPA9.086 CDR sequences
VISYAGEVKYYADSVKG

SEQ ID NO: 608 - protein, 12 aa, Artificial Sequence
  CPA9.086 CDR sequences
DPLPLHYYGMDV

SEQ ID NO: 609 - protein, 13 aa, Artificial Sequence
  CPA9.086 CDR sequences
SGSSSNMGRRPVN

SEQ ID NO: 610 - protein, 7 aa, Artificial Sequence
  CPA9.086 CDR sequences
SQNQRPS

SEQ ID NO: 611 - protein, 11 aa, Artificial Sequence
  CPA9.086 CDR sequences
AVWDDIGRVLQ

SEQ ID NO: 612 - protein, 326 aa, Artificial Sequence
  NCBI Reference Sequence: NP_076975.2
MRTEAQVPALQPPEPGLEGAMGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADLAGILGVSGVLLFGCVYLLHLLRRHKHRPAPRLQPSRTSPQAPRARAWAPSQASQAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVR

The invention claimed is:

1. A method of activating T-cells of a patient with cancer comprising administering an antigen binding domain that binds to human TIGIT (SEQ ID NO:97) to said patient, wherein said antigen binding domain comprises:
   a) a variable heavy domain comprising SEQ ID NO:160; and
   b) a variable light domain comprising SEQ ID NO:165.

2. The method according to claim 1 wherein said antigen binding domain is an antibody, and wherein said antibody comprises:
   a) a heavy chain comprising VH-CH1-hinge-CH2-CH3, wherein said VH comprises SEQ ID NO:160; and
   b) a light chain comprising VL-VC, wherein said VL comprising SEQ ID NO:165 and VC is either kappa or lambda.

3. The method according to claim 2 wherein the sequence of said CH1-hinge-CH2-CH3 is selected from human IgG1, IgG2 and IgG4, and variants thereof.

4. The method according to claim 2 wherein said heavy chain has SEQ ID NO:164 and said light chain has SEQ ID NO:169.

5. The method according to claim 2 further comprising administering a second antibody that binds to a human checkpoint receptor protein.

6. The method according to claim 5 wherein said second antibody binds human PD-1.

7. The method according to claim 5 wherein said second antibody binds human PVRIG extracellular domain (ECD) (SEQ ID NO:80).

8. The method according to claim 7 wherein said second antibody comprises an antigen binding domain comprising a variable heavy domain comprising SEQ ID NO:5 and a variable light domain comprising SEQ ID NO:10.

9. The method according to claim 7 wherein the heavy chain of said second antibody has SEQ ID NO:9 and the light chain of said second antibody has SEQ ID NO:14.

10. The method according to claim 1 wherein said T-cells are cytotoxic T-cells (CTLs).

11. The method according to claim 1 wherein said T-cells are selected from the group consisting of CD4$^+$ T-cells and CD8$^+$ T-cells.

12. The method according to claim 1 wherein said activation is measured as an increase in interferon-γ production and/or an increase in cytokine secretion.

13. A method of activating T-cells of a patient with cancer comprising administering an antigen binding domain that binds to human TIGIT (SEQ ID NO:97) to said patient, wherein said antigen binding domain comprises:
   a) a variable heavy domain comprising SEQ ID NO:150; and
   b) a variable light domain comprising SEQ ID NO:155.

14. The method according to claim 13 wherein said antigen binding domain is an antibody, and wherein said antibody comprises:
   a) a heavy chain comprising VH-CH1-hinge-CH2-CH3, wherein said VH comprises SEQ ID NO:150; and
   b) a light chain comprising VL-VC, wherein said VL comprising SEQ ID NO:155 and VC is either kappa or lambda.

15. The method according to claim 14 wherein the sequence of said CH1-hinge-CH2-CH3 is selected from human IgG1, IgG2 and IgG4, and variants thereof.

16. The method according to claim 14 wherein said heavy chain has SEQ ID NO:154 and said light chain has SEQ ID NO:159.

17. The method according to claim 14 further comprising administering a second antibody that binds to a human checkpoint receptor protein.

18. The method according to claim 17 wherein said second antibody binds human PD-1.

19. The method according to claim 17 wherein said second antibody binds human PVRIG extracellular domain (ECD) (SEQ ID NO:80).

20. The method according to claim 19 wherein said second antibody comprises an antigen binding domain comprising a variable heavy domain comprising SEQ ID NO:5 and a variable light domain comprising SEQ ID NO:10.

* * * * *